United States Patent 10,724,096 (METHODS AND COMPOSITIONS FOR INHIBITING AND TREATING NEUROLOGICAL CONDITIONS) - sequence listing, part 72

SEQ ID NO: 1521 - DNA, 3491052 bp, Homo sapiens (residues 1-1,745,526 of 3,491,052)
cagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcagcacagcggccctgctaaataaggaacgcctggagccgcggttggcacggccccggggagccgaaaaaccccgggtctggagacagacgtcccacccgggggctgtgcagacgccagcgggggcggggcgcggaggccgcgctcagctgggaggacaaacagtcgctaattggagaggaattgggatgcggcctggggctgcggggtacccggagaggtggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggcttgctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggagcccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcatgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaatgatgctgccgagaggtggtggcttttggaaaagatggcgtactgcaaaacgtgctgctctgcgtggctcgaagcttcgtggggagacgtgggcagagccgtggctgactcacagaccccccaccccagagcctgccctgccctccctgccccgacccttcccctcctgacccatgtgttttttttttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaatactgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagcgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatactttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtgtatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtctcgatctcttgatctcatgatccacccaccttggcctcccaaagttctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttgtccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggcaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctccttcgcctgcctgtccctctgctccggccccctgccgcctcctgcccccacctgtaggagccccaccctcctccagcacgtcttccctgcctccccaggggccgccctggtggggccccacggacccctggcctccggccagctagcagccttccacatcgctgccccgctccctgtcactgccacatgctgggactttggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctgaagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgctctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagctgagcactgcgtccggctcgggcccaccgggtggtgtaacaccgacctgtgctcagcgccgcacagctacgtctgcgagctgcggcctggaggtgtgcggggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcagtacggcctctcagccccgcacgagcccctggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagggcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgggaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggcttgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcggtgccaccatgctgggtacatgggggacagggctgttccatcttgcgggtacctgccccttcaccaggggccttgggaggggccatgagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccacgtgggactctccagcccgacgggaggtgtgtccaggaggcgacaggctaagggcagagtcctccacagagcccaggctgacaccagtccccccgcagaggtacagccccgtggtggaggccggctcggacatggtcttctggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccatacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggcgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagtgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgtcagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgctctcaccaccaaggtgcacttcgaatgcatgggtgagtgcaggcctgcgtagggggagcagcgggatcccccgactctgtgaggtcacggagccctcccgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctctccccctcccctctcccctcccccttctctcccctctcccctctcccctcccccttctctcccctccccccttctctcccctcccctctcctctcccccttctctcccctcccctctcctctcccccttctctcctctcccctctcctctccccccttctctcccctcccctctcctctcccccttccctctcctctcccccttccctctcctctcccccttccctctcctctcccccttctctccccttccctctcctctccccttccctctcctctccccccttttctccactcccctctcctctctcccctctcccctcctcctcctctcatgtgaagaggtgccttgtgtggtcggtgggctgcatcacgtggtccccaagtggaggccgtgggtcatgcagagccacagaaaatgcttagtgaggagactgggggggtccagtcaagtgggctctccagctgcagggctggaggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatccgccttatccccttcccctcccttccccctgctcctcttcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcctcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggacttcgacatccaacctggcggagcctgggctcacgtccactgccccttcccttcccaggaccagagacccagtggggagttaccgtctgaacctctccagtcacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggaatgagtctcgtcgcaggcgtcagaacaaggcagtttttgcagtactgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcaggcggaggtgccagcaccctccccgtggctgtttcttcaatacctccattttcctttattggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggcgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggcgtggacaggtgtgcagtgcgggtcactggttgtggtgtggactgaggcgtgtgcagccatgtttgcatgtcacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcccggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctatttcactcacatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgatggccgggtgtggtggctcacacctgtactcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactcctgcctgggtgacagagcgagactccatctaaaaaaaaaaaaaatgaaatttaaaactctgttccttagctgcaccagtctgctgtcaagtgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtgccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttagccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgagctttgtttcttgaaatgcacagattccttggacatccctgagaggccagtcatgaaagtcagcttggttttctccccctcatttgggttcagaatttaaagtccacacacacgggcagtaagataatatagataaggacatcatcactcggtttcggatgttaaaatgtctaggtgggttaggggtgatttgagatcacgcaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatccggcccggtccccgtccccttccctcccccctgccctaagccacctccacctctgtcctggccacctccgggtgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggccgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcataggttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttttacttatgctgagctttaaatgacaaagattcatataatccaagagagaagtattatttagagggattcttttaccatgtgatatataataaatgcatccaatgttatacatcaatttaaaaaacaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagagtcacttgaacctgagaggcagaggttgcagtgagccgagagcacaccactgcactccagcctgggtgacagagtgagaccccatctcaaaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagagggtcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggagagagatccgtatgtcaaaagtctgtacttggtaagaatttggctgctaagttgtggcataatttgtcttttgagccttttttcctttgggtaagttgagctctacattttgtcttgccattcatgacagtaaaaatgtggttgtgtgggggctgaacctccttctgaacaatgatccaagataaaagtactaataccacaatgctttttgatattcaagggaagaggaagtatgtttcagttttaccgcctagataattacacgtcatttggcactgcctttcaagatatgtggaaaacagaaaatatatgagttatgaagatatctaggcacatttaacattctctatgccacttagtcctgaacagagaatttttggtataaattggaggaagctttttttttttttttttcttttctcacccccaaaaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacaattccatttaggaaagttcagttgagctgttggacttggacaactttgtacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttttatcctatgtgcagaaatcaggaaaaaacaaattctacaaagaatttgaaagatattatttcaggccaggtgtggtggctcatgcctgtaatcccagcactttgggaggctgaggcaggtggatcacttgaggtcaggagttcaagaccagatgggccaacatagtgaaatcccatctctactaaaaagacaaaaattagccaggcatggtagcaggcacctgtaatcccagctacttgggaggccgaggcacaagaatcgcttgaatctgggaggtggaggttgccgtgagccaaggtagcgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcattaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctccggagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatttttttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggtgatccgcctgcctcggcctcccaaagtgctgggattacaggagtgagccaccatgccagcctcatgtcattcttgtgtggtgtgtgtgtgtgtgtgtgtgtgtgtgtgtgtgtgtgtgtgagacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggcgtgagccaccacacccaggctttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaactcaatgcttgggtcacctccagattcattttcacagtctttcatgttttggtcatactacattgtattttgctgccatatgactgatctttttttgttaaatgtgagatacttgttaaaaaatatttaacaatgaattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatctgagatcagaagcttcagatgcacttatgtcaactcaagagtagaatgcttccttagcctccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcacccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggagaagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcaggcagtaagcaagaggaggaatcaatatagcaacagtttggatcagactgtacagtttttttgtttttgtttttgtttttgtttttctgagatggagtcttgctgtgtcacccaggctggagtgcaatgacgtgatcttggctcactgcaacctctgcctcccaggttcaagtgattcccctgcctcagcctcccgagtagctgggattacaggcgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattgcacgcgatgggacttgtacacttgaaatgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgtttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaaactctctcctggccctcctctcttgccagcactatgggtgactgaagacccccagggaggcacagcatcctcttatctaagatttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcctggctggttttttaatttgtatttcctttgagacagcgtatctctctgttgctcaggctggagtgcaatggctcaatcagctcactttagccttgaactcccgggctcaagtgatactgccacctcaacctcccaagtctgctactacaggaacacaaactccttttttaaattttttgtggatatggggtctcactatgttgcctaggctggtctcgaactcccaggctcaagcagtcctcctacctcagcctccacaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtctcgagctcctgtgacacatgactcctctctcttcctagtgatccaagccctgccacttcctgactttgcccacactgtaccctctgcctggggcaacttcatgtctgcccattgacccttaggcctcagcccaggcacaagcccctgcctccggaggtcatccaggcctcaccaggctacaccctctcgtaaaattggattccctcccttcagggcagctttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagctcaccaggccaggcccagtggctcatgcctgtaatcccaacactttgagaggccgaggcaggtggatcacgaggtcaggagttcaagagcagcctgaccaacatggcgaaaccctgtctctactaaggagaatcgcttgaacccaggaggtggaggttgcggtgagccaagatcacgccattgcagtccagcctgagcaacagagcaagactctgtctcgagacaataaaaacacataaaaaattaactcgccatgatggcacatgcctgtagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattcccctgcctcagcctcttgagtacctgggactacaggcatgtgccaccacgcctgggtaatttttgtatttttagtagagacagggtttagtagagaccatggtgaaaccccatctctattaaacaaatctctactgaagatttgctgtactgaagggatagcaaaactcagttaccaaaatggcaatgtgtttgaactgtttacaggccaagaattcacatttgcaacccacgcaatacactactgattgtgtgacttcctctagagagaatgtcaaaagttacaatgtgatggcttttatgaatgtgagatgaggcccagtgtgccttctcctcttcggtttgtgcctcaatgatcatcacctcccaaaacatatgctgagctcccagcttccaggcactgtcccaaaagtggggtgtcagtgggaacccaagcaacagacaatatagagtctcgcacctcatagaactcattttctccttgcttctttttctcaccttttttttttttttttttttttttgagatagggtcttaccctgtttcccaggctggagtgcagtggcacaatcatagctcactgcaacctcaaatgcctgggctcaacgtagcttcctgcctcagcctcctgagtagctgggactacaggcacccgccaccatgtccggctaatttttctttctttcttttttttttttgtatttttagtagagatggggtttcatcatgttagccaagatggtctcgatctcctgaccttgtgatccacacaccttggcctcccaaagtgctgggattacaggcatgatccaccgcacctggccctgattttaacttctcttttttctttttttttttttttttttttgagacagactcctgttgcccaggctctggagtacagtggtgcgatcttggctcactgcaacttctccctcccaagttcaagcgattctcctggctcagcctctccagtagctgggaataaaggcatgcgctaccatgcctggatcattttggtatttttagtacagacggggtttcgccatgtgggccaggctcgtctccaactcttgtcctcaggtgatccgccggcctcggcctcccaaagtgctgggattatagccatgagccaccgtgcctggccttgatttttagcttttaactttgaaataactacagactttgaaagaagttgcaaaaatagtacaaagagttaccacatactcttcatccaagcttcctgaaatattgatatcttacatgaccatagtacaatgatcaaaacaaggaaataagcacggaaatcatacacgtacctaatctacagatcttattcaaatgatcaccgatcgtcaccctaaggttctttgttcccagtctggcctccaatcccagattgcttcacattgtgttgaactgtcaaatggccttagtctccaagtgagatcactaaccggctattctgtaggctgtccctcagtttatcaacccagttgttatgggctaaatgatgccctccaaaattcatatattggagccctaatttccagtacctcagaaggcgactgtgtttgaagataaggcctttaaaatggcaattaagttaaagtgagacctttaggatgggctctaatccaatctgtctggtgtccttataagaagaggaaatttgggggcatggttggtggctcacacctgtaatcccagcactttaggaggctaaagtaggaggatcacttgaggtacgaagatcacttgagaccagcctggccaacatggtgaaaccccatctctactaaaaattagctgggtgtggtggcacatgtctgtaatcccaactacttgggaggctgaggcaggagaatcgcttgaacctgggagagggaggttgcagtgagaggagatcgagccactgcactacagcctgggtgacagagcaagattccgtctttaaaaataaaataaaataaaaaaaaaatttggacacacaaacaggcaccaggggccgggcatggtggctcatgcctgtaatcccagccctttaggaggccaaggcaggaggattgcctgagctcaggagttcaaaaccagcctgggcaacgtagtgagaccctgtcactctctctctctttttttttatttaaaaaataaataaataaaacgaggcaccagggatgttttcacaccaaggaaagaccatgtgaagacacagcaagaaggcagccgtgtgaaactaacccagcaggcaccctggtcttggacttcttgcctccagaagggtgagcaaataagtttctattgtctaagccacgctgtgtgcgctattttgttatggcagccccagcaaactaatatatccattctcttcagttcttggaaatctgcccatttctatgttctctgaccctttttatctgcccgtttattgatttatagccttctccggctccttatccttgttactggtccggagtaaacttctgttagatttctcccagctgggcaggcttccagctcaccaaaacatctccttctttgctttttacttatatcccccttgtatcatttttccatggctgaggtaacaaattaccacgaatttaatggcttaaaagaacacaaacttcttgtcttagaatttggggtgtcagagtctaaaatgggtctgcaggactgcattcctcctggaggtcctaaaggagagttcattttcttgcctcttccaagcttctagatgctccctgcactccttggctccccatccaacatcttcaaagtcagcagcataaatcttcccatctccctttctctctcttttttttagacaaagtcttactctgtcacctaggctggaacgcagtggtacagtcatagctcactgcagcctcaaaccccgaggctgaagtgatcctcccgcctcagcctcacgagtagctgggaccacaggcatgcaccaccatgcctggctgatttttaattttttatagagacaggctcttgctatgtcaccagggctgtcttgaatttgggagcccgcgatcagaagccagcatggtcggcagctccctacaccacgtccgggcttcccgggcctccagctgccccctgcgccgccgccgcctcccgcacctgcacgtggccactccagatgctccggagggattgagcaccccgcgcacacccagctcacaccatccaatccggaggccatgggccgacatgggggctgagcgtttgaaatgagcccggaccaccagatgcatgggtccgttcacacgaaatacccagaacaggcaaagccacagaggcagaaagtatggggttatttattttaattaattaattaattgttttgagacgtagtctcctctgtcgcccaggctagagtgccgatccctatgttagcttgatgtggtggctcatatctgtaatcacagcactttggtaagctgaggcgggaggatcgcttgtcaggccaagagttcaagaccagtctgggcaaaatagtgagacccccctgctatggtttggatttgggtccctgcccaaatctcatgccgaattataatccccagtgttaggggagggacctggtgggaggtgattggatcatggggggagagtgcctccttgctgttctcctgatagtgagtgagttcttatgagatctggttggtttaaaagcatgtagcgcttcccccttctctcccttcctcctgctccagctatgtaagatgtgcgtgcttcccctttgccttccgccatgattcaaagtttcctgaggcctcccagccatgcctcctgcacagcctgtggaactgtgagtcaattaaacctcttttctttataaattacccagtctcagggagttctttatagcaatgcaagaacggactgatacaacctccatatctacaaaaaaaaaaaaaaattgttttaattacctgagcatggtggtgcacacctgtagtcccagctactctggaggccaaggcaggaggatcactccagcctgggcaacaagagcgaaattccgtctcagaaaaaaaaaaaaaaattaaaaaatttaaaaaacgtaaagaaaaaaattattttgctaaatctggcaaagccaaagggatgaaactgacatttactgggcaccttctgcacaagtcagttctcctaggaacccagagaggcaagggattggtagcaatctctagaggcaaatatcctctaatatccatggtgttctttgtggagcagctcaatggatttacttaatgggaaatgaaagaaggaaaaatgaagacttagaaggcttcgatgatttccaatgcattactgtatacttatctcttcttagaagcaatagaaaaaaaaatcaggaattaaagacaatctattactcaagcaaatgctaaaggcctcccatggtcttcaaacaagaagagatgctctaagataaattacttcattacgttgatgcttcatcatccgtggaagctgtgactcagagccctgcagcaataattaggcagtgcgttcatgtcccgttaatgtccccaaacagtgggagatgaatggagaacatagggctgtgttcgaatgaaaaaagggttttgttcggcgctctttcagcagggaataagtactgatgtgggaactgagcttctgtttacaactaaggatcacattaaaaatatattaagatgactacagtaaagcttattgtagctattattatttcatttaaatgaatcccagtttcataagaaccaccaagggggctaccatgtctaaaatgtaacttctctgcgaatcctgaaatttctactgacaaaagactacgatgcacaattaattaattaattaattaattaatttgagatggagtcccactctgtcacccaggctggagtgcagtggcacgatctcagcttgctgcaacctttgcctcccgggttcaagcgattctcttgcctcagcctcctgagtagctgggattacaggcatgcgccaccacgcctggctaaattttttcgtatttttagtagagatggggtttcgccatgttggccaggctggtctagaactcctaacctcaggagatctgcctgcctcggcctctcaaagtgctgggattacaggcgtgagccaccatgcccggccaacacgcaacatgtttaagaccaaaaggactgttttgcaatgaagcagatgaatcaaccagtaaggccaacccctcaaaaaatgtagcactgaagtttcttcaacatctgcctctgagacttgttcatatgtgcagacacagagcaggaaactaaagcaactgccttcctctttgtcacctgaaatgagaatggagagaggctggcaaggaaatgatatgtaatcttccctccttcctgattttcttttctatccttttttttttgagttggagtctcgctctgtcacccaggctggagtgcagtggcacaatcccagcactttgggaggctgacgggggtagattacttgaggccaggagtttgataccagcctggccaacatggtgaaaccccatctctactaaaaatacaaaaaattagccaggcgtggtggcatgtgcctgtaatcccagctacttgggaggctgagcatgagaactgcttgagcccgggaggtggagattgcggtgatctgagatcgtgtcactgcattccagcctgggcgacagagtgagactacatctcaaaaaaagagaaaaaaaagaaaagaaacatttacaatctattcactctgaaatttacagtctatttactctgaagcctgctacctgaatgcttcatctatgagataaaactttagtctctgcaacctcttattgtaacccatatatccctttctattaataataactctttcaaccaattgcccatcagaaatctttttttcttttttttctttttttttgtttttttttgttttttgagacggaacctcgctctgtcgcccaggctggagtgcagtggtgcgatcttggctcactgcatgctctgcctcctgggttcacgccactctcctgcctcaggctcctgagtagctgggactacaggcgcccgccaccacacaccactaatattttgtatctttagtagagatgaggtttcaccgtgttagccaggatggtctcgatctcctgaccttgtgatccgcctgcctcggcctcccaaagtgctgggattaccggcatgagccaccgcgcccagcccagaaaatttttaatctatctataacccagaccaaaccaatgtaaatctttaaatgtatttgactaatgtttcatgcttccctaaaatgtataaaatcaagctgcgcccggaccaccttggggatgtgctctcttgctgctacgctttctgcaaattttccatacaatttttctttttcttttttttttttcacacagagtctcactccattgcccaggctggagtggagtggcacgatcttggctcactgcgacctctgcttcccaggctcaagtgattctcccacctccgcctccaaagtagctgggactacacgcccagctaatttttgtgttttttgtagacagggtttcgccatgttgcccagactagtcttaaactcctggactcaagcaatctgccctcctcagcctcccaaagtgctgggattacaggcaggagccactgcacccagctagaagagggaaagtttaatatagttgattctcattattcaagatagttacattcaaaaaagtcaccaaggacactgaattggtgaatattgaatcatttgctctaaaggaaatgcaggattgggtgtctccaagcctctggtcgcaacatttttataaagcaatcaatacataatcttcttttatgtgtgtgtgttaaaggacgccttatctaatacatattgttgattcattgacattgaactcacggccaacagcattgtaactcatgcctgaacaaagcttatctaacaaatgtaccttctccattaggtacttcacagccttcttgcactcagagacactggatagcacttcaggaggacacttaggggccttctgttgttgttgatgttgagatgaagtctcgctctattccccagtctggagtgcagtggcgtgatctcggctcactacaacctccacctccaagattcaatcgattctcctgcctcagcctctggagtagctgggattccaggtatgcgccaccatgcccggctaatttttttaatttttagtagagacagggtttcactatgttggccaggctggtctccaactcctgacctcaggtgatccaccagccgtggctttccaaagtgctgggattacaggtgagagccaccgcacctggctgggggccattttaagcagcaaaatcacaaaaagcacagaactgtgaaagatgtgacactgaatacactgcagagaggacacttgtttgcagtctgaaagctgagacaagaaggcagagtgtggccaggtgcagtggctcatgcttgtgaccctagcattttgggagactgaggcaggacgatcacttgaggtcaggagttcaagaccagcctggccaacatggtgaagccctgtctctactaaaaatacagaaattggccgggcgtggtggctcacgcgtgtaatcccagcactttgggagaccaaggcgggtggatcaagaggtcaagagatcgagaccatcctggccgacatggtgaaaccccatctctactaaaaatacaaaaattagccaggcatggtggcacccgcctgtagtcccagctactcaggaggctgaggcaggagaatcgcttgaacctggaaggcagaggttgcactgagctgagattgcgccactgcactccagtctgaagacagagcaagactctgtctcaataaataaataaataaaaataaaaatacagaaattagccgggcatggtggcacgtgtgtggccccagctactcgttgaggcaggagaattgcttgaacctcagaggtggaggctgcagtgaaccaagatcatgccactgcactccagtctgggcgacagagcaagactctgtcttaaaaaaaaaaaaaaaaaaaaaaaaaaaaaaagaaggcagagtgtcaccttgttggacctcagctgggaatgggtgcatcatgtgacttaaatattttgctgctctctgcatgtacatgtcttcagataatagcaaaagcaccagaggtattgatttggggtccaaatacattttagaaaggtagacacatttataaatatggaacccatgaataatgaggatggactgtatgaagaattgttaataggagactggaataatgagggtttgagtagtaagaagggaactctgaagagtatacaggcagatgcagggggctcatgtctgtaatcccagctctttgggaggctgaggcaggtgattagcttgagctcaggatttggagaccagcctgggtaatacagcaagactccatttctaaaaaaaaaaaaaattttttttttaattagctaggcatgggggctcatgtccgtagtcccagctactcgggaggctaaggtgggaggattgcttgagccagggaagcagaggttgcagtcagccgagattgtaccactgcactccagtctgggcaacagagtgagaccctgtctcaaaaaaaaaccaaaaagtatacaagtagtagatacaaggaacagctactacccctaggactgagatatgacacttacggaaacaatcacccctggagggctgagatcttgaccaggtagagagggtacagccctgggtcactgaatagcaaagaagacagttgacgtgatgccctgctggttggtggaacttgctggaaatctaccctcagggtaaacttttcatggcaaggtgtctcactgaaggtactctgctgcaagaccaccagaggggagtgccaggggaagctgcctgccaatgagtggtataggagctgggcactggagaagccatcagcaggaaccaataagcaaaaccctttcctcctgcagtgtctctccagcaccctgtactgacaaaacttaaaataacattgtgcctcctggcaaaggaaagctatttaaagggcccagatccatttttacccagaaggcaaaaaggatggatttggagctggaaggcaatagatcaaaaactgactgttttgatgttttttattttctttttttagagatgggatcttgctgtgttgcccaggctggcctcaaactcttgggttcaagtgatcctcccaactcgatctcctgagtagctgggaccatgggctcctggcattgtgcctggctgtttagtggttttaaaaaataattctacaagtatgaaaaacaaaaaagtgtaattaagaaaattaacatcttggctgggcgcggtggctcacacctgtaatctcagcactttgagaggccaaggcggatcacctgaggccaggagttcgagaccagcctggccaacatggcacaaccccatctctactaaaaatacaaaattagccaggagtgatggtgggtgcctgtaatcccagctatttgggaggctaaggcaggagaatcctttgtgcctgggaggtgtaggctgcaatgagccgaaattgtaccactgcactccagcctgggcaacagagacagactccatctccaaaaaaaaaaaaaacaaaattaacatctctagtgttaaccactcttttcattttttatgaattttttatagtcttttctatgcatgtagtttttcatttaaaaaaaaattaggttcatattacacatgctgtgttcttaccagcccttttgagttaacagtgtcaactttccatattaacaactgtgtacctgcatcacttttttttttttttttttgagaaggagtctcactctgtctcccaggctagagagcagtggcgtgatgtcagctcactgcaacctgtgcctcccaggttccagtgattctcctgcctcagcctcccaagtagctgggattccaggtgtccaccaccatgtccggctaatttttttgtacttttattagagacggggtttcaccatgtcagccaggctggtctcaaacttctgaccttaagtgatcctcccacatcggcatcccaaagtgctaggattacaggcgagagccaccgcacctggcactttttttttttacagcttgtgtcttaaccagttttatggaagtaccactatttagccaattccctgttattttgttgtatatatagtttgttttcaattttgtttcattataagcagcgctactgtggacggtcttatagttaaacctctaacatatttatgtatttagtttacactttgggagtagaattttaagtacaaaacctaggtatattttaagtgtttttgttactgaatgcccagttccattcagttcaacacaaatgaaatacgtcaaaggttttataacaatctgaaattctaccagcaatccataagaatacttattttcttctatttttttttgagacggagtttcgctcttattgcccaggctggagtgcaatggtactgtctcggctcaccacaacctctgcctcctgggttcaagcgattctcctgcctcagcctcccaagtagctgggattacaggcatgcaccaccacgcctggctaattttgtacttttactagagacaggaatttctccacgttgctcaggctggtctcaaacttccaacctcaggtgatcgacccgcctgtgcctcccatagtgctgggattacaggcgtgagtcaccgggcccggccgagaatacttatttccgtctacactaacacgggatgttattttattttattttttgagacaaagtctcgctctgtcgcccaggccggagttcattggcacgatctccactcactgcaacctccgcctcctggtttcaagcaattctcctgcctcagcctcctgaatagctgggactacaaggcatgcgtcaccacacccggccaattttttatttttagtagagatggggtttcactatgttggtcaggctggtctcgaactcctgacctcacgtgatccgcctgcctcggcttcccaatgtgctgggagtacaggtgtgagccaccatgcccagccggatgttattattttttaaaaaaactttgctaattataggcaaaaatgctatttgatccatttctgcaattttggtcactagtaatgttgaactttttgtcatgttgactatttgcatgtttttcctttttatattgtcggttaatgtctttgcccatttgccttctgggcacacagttttagagaagcctgttcactttcatgaaatgtaaataaatctgaaacaaattaaacatcaattatagtttaaaatgctaataaaaattcttattttcagccaggtgtggtggcttatgcctgtaatcccagcactttgggaggccaaggtgaatggatgcttgagctcaggagtttgagaccagcctggacaacatggtgaaaccccatctctaccaaaaatacaaaaattagccagcggtggttgtgtcctagccactgtggaggctgaggtgggaggatggcttgagcccatgaggcagaggttgcagtgagctgaaacaccactgcactccagcgtgagagacaggagtgagagcctagctcaaaaaaacaaaaacaaaaacaaaaacaaaaaggtcctttgagtaccagaaaaattgtcaatgggaatactttcctcaaggtcttgaaaattaataataaatcaacaaatcattgatggtagtggctggtgttgctttcttctatatctagctagttatcactgaacaaacattttctaaaacattttcgatgtttcagagcagagatttcaaattgacagccaagggacggattcatgcataatttactctcttttattttgctttatttttcttatggtatttacaagtaattaacatacattatatagctacttatctctctgttacaataggatataagatccacaaaaatagccagacacaatggcttatgcctgtaatcccagcactttgggaggccagggcaggaggatcacttgaacccaggtgctcaaagaccagccagagcaacatagggagatcccacctcttcaaaaattaaaaaattagctgggcgtggtggtgcatgcctgtagtcccagcagtttgggaggctgaggtagaaggatcacttgaacccaggaggttgaggctgcagtgagccaggatcatgccactgcattccagcctgagggacaaagtgagacctacctacctcaagttaaaaaaaaaaaatccgcaaaaggcaaagacttaatcccttttaatgattattgtatctccaatttctaaaatactgtgtggtatataatgcaccttcagaaaatatttgttgaattcacgcatttagtaattatttattgaactcccactgcatcctaggcactggattagctagacttgggaggtaaatgcctctgcctccatgtagtgtctttaaaatatgattctcggccgggcatggtggctcacacctgtaatcccagagctttcagaggctgaggcgggcagatcacctgaggtcacaagatcgagaccagcctggccaacatggtcaaacccggtctctaataaaactccaaaaattagccaggcatggtggtgggcacctgtaatcccagctactcaggacgctgaggcaggagaattgctcaaacccaggaggcagaggttgcagtgagctgaaatcaagccactgcactccagcctgggtgacagaacaagactctgtctcaaaaaataaataaataaaataaagtatgatgctcattaaaaccagattgaaaacaatggaaatgttttggaaataaaatatacacactgtgccagtatgtggattcattactcattaattctatgactattttttgagagcctatttgcagtcacttggggacacaataatattaaagacagattctgtccctgcggatatggcattgataatctatcaagggaggtagacattaagcaactaattaatcgtgattgtgccaagtacataaaggagaaagacaggtgcctataagcactcatgagatttccctgagaaaatgatacttacacttctaccaaagggattagaagttacacaagacaaaagggaagggaaaaaaagaacagtctcatcgaagaaaacagcttgtcaggaaagatcttgctgtacagaaagaccaaggggggcactgtggctcgcgcctgtaatcccagcactttgggaggccgaggcaggtggatcatttgcgctcaggagttggagaccagcctaggcaacatggtgaaacccacaaaaatacaaaaaaattagccaggcatgatggtgtacacctgtggtcccagctactcgggaggctgaggtgggaggatcacttgagcctgggaagtggaggttgcagtgagctgtgttcacaccactgcactccagcctgggtaaccaagtgagaccctgtctcaaaacaaaaacaaaaagaaacaacaacaacaacaaaaagaccaagagaataatcaagggaataatgacagccagagaccaaagaggtaggcaggggccatattctatactcatgggccaagtgaaggatgctcgctttattccatggacagctgaaggtttgtaagcagatgatctgatttctacattaaatagatgactctggtttctgtattgagaatggtttggctacacagactgcttagatatggcagtagtcaaggcggtagcaacggaaatagagatgcagacagctttgagagatatttaggaggtggaagtggcaacactgattggaaggggttagggaagggaaagtgtgagagagaggaagacaccctggttcctggcgtgaacagctgggtggatgatggggagcttttatgggatgtggagtgcgagaatccgtggtttagggtagaagacgagttcagtgcaatcaaggcacagctataaatgtgtacaactgaggcagaagtttcagaagcaatgagtacccttactaccatagaagatgctctgattttttttcttttttctttttttttaagaaatttttggctaggcatggtggctcacacctgtaatcccagcactctgggaggctgagttggatcatttgaggtcaggagctcgagaccagtctggccaacatggtgaaaccctgtctctactaaaaatacaaaaattagttggacatggtggctcacacctgtagtcccagctacttgggaggctgaggcataagaatcgcttgaacctgggaggcagacattgcagtgagctgagatcacaccactgcactccagcctgggcaacagagtgagactcggtctcaaaaaaaaaaagaaaagaatttttttacccaatagtaaaataaccaaccaatgcgctgatattttttaatcaactttgttgaagtatgttttacataatagattttcatatgttttacataatataataaaattcacccatattacatgtacagttcaacaggttttgacaaatgtatatacctgtgtaaccaccacgattaaaatacagagctcttctgtcatttccaaaaactccccagcaccccttggcagtcaattccccctccatctcagccccaggctttctgtcattatagtttgcattttctagaattccatataaatgaaaccatagagcatatatacagtatacatatgaaataggtattcacttgtatctggcttttttatttccttggagacagggtcttgctgtgtcacccaggctagagtgcagtggtgcaatcacagctcactgcagcctcaacctcccaggcttgagaaatcctccattcccagctaattttgtttttttttttttggtagagactgggtctctctttgttgcctaggctggcctcagattcctgggctcaagcaaacctcacacctcggcctcccaaagtactgggattacaggctccaggccatgtatctggcttctttcactcagcataatgtttttaagattcatctatgacagggaccagcaaactagggcctgtgggccaaatctggcccagtacctgattatgcaaaggcctaagagctcagcatgactttatatttttaagagattgaaaaaaaactcaaagaagaatattttgtgacacatgtaaattaaatgaaatccaaaattcaatgtctataaataaagctttattggaacacagcaacgctcacttgtttacatactgtctgtggctgtttccatgctacagaatcaaatacttgagaccgagatcgcaagaacctaaactacagcttgcaaagcctgaaatatttacaaccaggccctttacagaaaaagtctgccaactcctaatctgtggtgtcccatggatcaataatgtactccctttacttgcagtacagtactccattccattgtagggataggccacaagttgtttacctgtttgtctgttgatggacatttgggttactgcccaattatccttaatccacgtgatatgctctgatgttttgcatcctatttcattttttaaaaaattgctactcatgacccaatggttgatatcacaacccactgatgaactactctcagtttgatatagatgttaattgaaataatggaggatgaaattatgtagaagaagaaatcaaaaggactttccaggctgggcacagtggctcacgcctgtaatcccagcactttgggaggctgaggtgggtagatcacctaaggtcaggagtttcagaccagcctgaccaatatgatgaaaccccgtttctactaaaaataaaaaattagctgggcatggtggcacgtgcctgtaatcccagctactcaggagtctgaggcaggaaaatcgcttgaacctgggaggtggaggttgcagtgagtcagcgagactctgtctcaaaaaaaaaaaaaaaaaaaaaaaggcttgccagctgagtgctgaggaaatccaacaatgaaacattgggtggaggaggaggaaactccaaaagacattgagaaggaacaggcagaaagggaaggtgacgatccggagaatttgatattgtgggaagcatggaaagtcagtttcaagaagaaagtgatcatctggttctagggctgctgagaggtcaggtgtgatggactgagatggttttagtgacactggtttgggtggagggaacaaggccgaagctagattcagatgagttggtggtgcttgtgtgatgagaaaattgagaccattaggtgtaaccagaaggggatgtggatgaagataaggagtttttatttgcttgttttttgagcataagaatgtttaacaaacactaaaaggcaagcataaccagaattttacagatgaggaaactaatataccaagaggttaagtaacttgcccaagtagttttcacttatacagcttaaaaaaaaaaaaaaaaaagaatccagttctacttgtagccacagtctgaactctaaccaatgggctataccatcgacaagggaaaaaactggcccagacataatccaatttttgtacctttgagttaaaagtctacagttgaggctgggcctggtgtctcacgcctgtaatcccagcactttgggaggccgaggtgggtggaccacctgagatcaggagttggagactagcctgtccaactagtgaaaccccgtctctactaaaaatacaaaaattagccaggcttggtggcacgcacctgtaatcccagctactcaggaggctgaggcaggagaattgcttgaacccgggaggcggagcttgcagtgagcagagatggtgccactgcactccagcctggcgacagaacgagactccatctcaaaaaaaaggaaaaaagagaagtgtttgaggccaggctcggtggctcaggcctgtaatccaaacactttgggaggccgaggcaggaggatcacttgaggttgggagtttgagaccagcctggccaacatggtaagaccctgtctctactaaaaatacagtgtgtgcgatggcgcacgcctccagtcgaagctactccgggaggctgaggcagcagaatcacttgaaccggggaggcagaggttgcagtgagccaagactgcgccgttacacttcagcctggacaacagagtgagactcgtctggaaaaagaaaaagaaagaaaaagacaggtctgttagcagcacataaagccatatgtcagtagagattaaacctccccacaactgatggcttcatgctccaaactgtacaatattctgcttatctctcttcactagtccatagaatgttgcattataatgtatcagttttcctatctgtgcatccacaagccaaatggtttcaacttttttttttttttttcggggatgggggaatcacagacttgagtatataatgaagacaatggatgttttccccagaaaaatgcactcactcacacacaaaatgttgagtatagtttcagagacctccatctgcatcccaaagtaaaaacttctacccaaaatagtgtttttcttcagggcagagagcttgtctttgttttgtgtgtgtgtgtgtgtgtgtgtgtgtgtgtgtgtgtgtgtgtgtgtgtagacggagtcttgctcttgtcgtccaggctggaatgcagtggtgcaatcttggctcactgcaacctccgcctcccaggttgaagcgattctgctgcctcagcctcccgagtagctgggattacaggcgcacaccaccacacccactaatttttctatttttagtacagacgagggtttcaccatgttggccacgctgttctccaactcctgacctcaggtgatccgcccacctcggcctctcaaagtgctgggattacaggcatgagccaccgcgcccagccttttttaaatttttaaattttttattatattttgtttttgagacagagtctcgctttgtcgcccaggctggagtgcagtggtgcgatctctgctcactgcaagctccgcctcccgggttcacgccattctcctgcctcagcctccagaatagctgggactacaggcgcccgccaccatgcccggctaatttctttttgtatttttggtagacacggggtttcaccgtgttagccaggatggtctcgatctcctgacctcgtgatccgcccgcctcggcctcccaaagtgctgggattacaggcgtgagccaccgcgcccggcccagcctcttatttgtatttttattgttttttgagatggagtctcgtcttattgcccaggctggagcgcagtggcacaatctcggctcactgcaacctctgcccccggggttcaagtgattcccctgcctcagcctcccaggtagctgggattacaggtgtttgccaccacgcccagctaattttttgtatttttagtagagacggagtttcactctgttggccaggctgctcttgaaccagcctcttattcttttacatactatttccagcacaactgtccaagatggcagtcaataaatgtttggctaaatataataaataatacggttgattatttccactttttcatgttgggttttcaaagtctacttttaaaacagtaaagttaacttttctctctagtatttgttttgtagaatctattatactttgtaatgtaatccacagaaacttggaggtgactttagtaaaatttactagttttgaatgatacccatgctgaggtgctcagaggtgaaatgtactaacatatatcgatggatggatatatggatgcatatgtgattaaagcaaatatagggaaaattaactgtagaatctaggtagtgggtatatggttgttcactgtacaactgtttaaacttttctacgtttgaaaaatttcataacacgttggaaaagtgacttgttttgctcaagcaggggtacattcaatcttcaattcttgaaagacataaatctatctttccttctgtttggaaagctctttagagagtcagaataatccccacagtacagtctaaaccagcacacaagggttttttggtagaaaataattttattaacataaccaggcaatttaccaaatacaacgtagatagctcaaaacatggagttactgcgctgaaaatgtgaccctgtttacacagatttcgggacgaagagtataaaacaggagagaaaaggagtaagattgtggttgtagcgtcatcgcagaggtgaagtgttccattgattgccactgtggtagtctatatcagtttcccacattaaggtgggaggaatctactaagcaaatgtacgccctccccattcgttcgaaacacattgcagtaaaattgcaaaagtggccgggcgtggtagctcatgcctgtaatcccagcacttggggaagctgagacgggaagatcgcctgaggccaggagtttgaagccagcttgggtaacatagtgagacacccctaccttctctattaaaatgagattttaattttttttctcttcagttcatcggttaacaagataaaaaaattaataaaaaattaactttttaaaacatttaaagtaaagtaggagtggaagcagtatgtggactcatggggcttgggtctgaatcctacctagatcggcactgcgaaatggggataatgatctcctagagctgctgaaataggaaaatggaagaacagcagctgatgtattaatattatcattattactactacccattacctgacaagtgataattgtgacatgaaagaggctggaccggttgttacaacaattttttccgtctagaattcggcggtaaggtctgagacaacacctcagcttagatcagtgccttctctgaacagcgttcactaagcagcccccaaccccaaaacccccaagtccccgggcgccgaggacgctgcgagtcctgcgcatgcgcaaggttgcccactcgctcaccgcctccttggcgaatggcctgttccattctcgagggatgccggcgggaggtgaggcgggagacttggaagcctgggcccggaagtgaggtgcgtcactagtatttccagcctttcactccatgaatagtactttgtgattattatacttctaccttgatgattgcaacaggctgctggaaagagtttggtgaacaatccaccgggcatcctccccccttcacctgcgcacgttagggagggccggcgtggcgcccaggtacggaatcccagagggctccgcccagcgctacggggccccgccccgccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaaggtccgtgccgggagggggcgatggggacggtgctgcggcccggggctcccgcttccgaggcaactgtttcccagtcgcgagctgccattgtgacccggacagggggacgcgggctgacaggccctgcctgaggaggcctcgccgggagggcggctggggcccgggcgcgtcacggggccgggtgtctcttgggtccccgtgggccgaagaggctgggcggggttcggtgggggccgcgacgggcccggagcccaggactgggaccgcggggccgaccttgggccctgccgaggttccgcgagtggccggcctgagctcggctggccctttcggaggaccgggagctctccgttggcggccccagatgctcccggaaagaagccgcagttatttcagagccagctgcaaacctgtaggtttttcttggtctccgagttaggaatgaaaattgccaaagcagtggttttccaacttcagcctgagtgggaatcacctggggcctttggtaaaatgcggaggttcagtcccggggtcagaacctctgggggcgggaccgggaactgcgtgtttaaccgccaccgccccgctcccactccgccccacgcaggtgattctgatgctgagcctgcgatcaccgggcgagaacctctgagttccagaaaggggtgggtgttgcgtagattgcgaattgagttttggggatcgcagctgctccacaacttcctggctcccccattccagtggcgaggagggatccccgagtcaactcgaaatccactggtaacagagcctacctctggtttccccttgggggaacggcagcgtggtgtaccaggctgactgctctaccatgtgaaacggattctcattgtcccagtgttagggcttgtaaatggaaaccagtttgggtttcttcacggattcctgctttcggtacctgacattctgccctccctcaaagcccttctgtctgttccagcttgggagtctgcttgtccaatccagtgcatacccggtttttcatgcatgtggcattcaggagcaatgctcgtgttttaagacggctacattttaattttgagctggtaggaataatatattttgtcttttttcaaggcagcagctgctgtagattttgttcacttgtcactggagagttgaaggcaataattgtaaaggttgggccagatgtcttcatgtgctcacagtggtatagcctactcctgggttgcttagcataaattgggtggaagacaagaaaaagataatatggttttcttgtgccatctctggggtgaatgttacgtgttttcctggctgggaataaagtctttccggtcgtctgattagcagggtgtctaccttttggtactttgagtttgtccagatgagtggttcttaaagcagggggcaatttatttccccaggagacatttggctatctctggacatagttttgattgtcacaatgggggcagggaggtgctgccggtacctagtgggtagaggccagggacgcctctaaacatcctacgttgcacaggacagccccccacgctggagaattctctggcccaaaatgtcagcagtgttgaggctgagaaatcctggtcaagatcatgtttataacaccagcagttgagtacaaaacgatgcaaagtggtgttatcaatttcctaagaaggtgggtgggcttcatgtgattgtaattggaatcctgaagaactggggtgatctttcctccaggaataattagcctttataggaaaatctgcagggtgggtcagaatcctgctttaaatattacttttctggcatttgatcagtaggttacagtagttgctccctaagtgttaattgatgataaaagatcttaaactctctcaatgaggatcgcaagagggactgaaattccagtgtgtttaatattggagcattcacaaaaattgtagtgatcttttaggaattcagaacgtgtgggctggaggtttctgccttaggtcaatgtgaaaattctgagtgtaagtttttcagaactatgggacttacttttttttttttttttttttttttttttgagagggagtctcggtctcttgcccaggctggagtgcagtgaggcgatctcggatccctgcaacctccgcctcccggattcaagtgattctcctgcctcagcctcccgagcagctgtgactacaggcgtgtgacaccacacccgactaatttttgtattcccagtagagatggggtttcaccacgttggtcaggatggtctcaaacgcctgaccttgtgatccttcagcctcagcctcccacggtgctgggattacaggcgtaagccactgcacctggccgggacttagatttatattccctgaagtaatacagggccttagatggaataaacgatttatattggtgctaattgggcagaaaagaaaaagcattgctgtaatatgaatgttgatgactttatgttctgaaaaatagtctgggtcaaagtgaaacatttaattgtgttcattattcctgtttctttgaggaatagactatcctgcgttaaattctacattgttaatataaactcaagagctatgtgagcagttgtaaatgatcccatttaaactgattgttgcataatttatactgattacagaaaccacaatgttatttgatgctcaccctctaaaatttaaaataatatctctcactttaaaatgtatgtgaaaaaacaaaaacaaaatgtagtatgcgatcatcatttagtagaatcactcagtgatttggatttggtccaaatatagttctgtcccttgctttttctgttatgtaaacgtgcagacctgtgataacagagccattttctcgtcacgatttgcttttcttccacaacagtatcagttttcttgtatctgagatcagtgatgtcccaataaatcagatgggttaattgaggaggcaaaggaaattcaaacttaggagagtaggagtaggggctttgcccctgccccccactgtatgtccaaggcataaggaacaaggccctgtagcagagtctcacagtgtgtacttatgttaatattcaataaggaaaatgccacaggaagtaatcactataatgatgaagattttaagttattaaacacaccttccagtaaaaacctgttatattattattatttttgagacaggatctctctctgtcacccaggctggagagccgtggtacaatctcggctcactgcaacgtccgtctccagggctcaagtgatcctcgcgcctcagcctcctgagtagctgggactacaggcactcacccccacactgagctaattaaaacaatttttttgttctcgagacaaggtctcactatattgcccaggctggtcccaacctcctgggctgaagccatcctcttgccttagcctcccaaagtgctgggattataagcgtgagccaccgtgccaggccaaaacctgctactctaaacttgtagaatagcccagacctttttctgttggttaaaagatctcattcttcctgggtattatgtttaggcaaggtatactgcagtttgtttgcatttactttaattctgtccttgagcaaacttaaagcagtttctcagcgtcagcactagtgatattttgggtcagataatttgctgttatgggggctggcctgtgcatggcagcatgcttagcagtgtcccagacctctgctcagtagatgctagtcgcactccctacacccagttgtaacaataagaaatgtctcaagatgggggcagttgtcccccaaggggtagagggaattgcctgtcattgaaagtccctaatttagggaatctagagctacagttccggtttggtcaccactagccatatttggcagtttacattgagattaaaattaaacacaatttaaaattcatttcctcagtcatgctagccacatttcaagtgctcagcagccacatgtggctgatgtctgctacactgggcagcacagatgtggaacatttccatcgcaaagaaggttccactggacagtgctaagagctggcaattcgtgttttttttttgagatggagtctccctctgacgcccaggctagagtgcagtggcacagtctctgctcactgcaacctctgctttccgggttcaagcgattctcctgcctcagcctctcaagtagctgggattacaggcacccaccaccacacctggctaatttttgtatttttagtagggatgggatttcaccatattgaccaggctggtctcaagctcctgacctcaagtgatccacccgcctcggcctcccaaagtgctggggttacaggcatgagctactgtgcccagccaattacttgttatatctaattctcatctctgaaagaggcaactttgaccctgtttctgacctaaatcagcacaactcagcccatttttggttcttgaactcatcctgagctaagtgtttctttcctgctatttgggactgattttagaaaattctttgtcaccttgctgttatgctagaggtttatagcagcatcaatggaacattcctgatcattacttactgataaggactccgagaatttctattcctgctccttccttaaaaagcatgagaaaagaacccctgttaggcaaggttgaaatgaccagtttccgtgtatggctttgtagatcccactcttttatatagaatgagaggagatgagaggctgtaattgtagctttcatataaagccaattccaatgttacaatgtgagggttttgcatacagatgcatggtggctatggctgtaaatgattatctaatactggctgtcagggaaaactgatgggactcggccatagtacaaagttcctgatcctagatatttatggctttgttcattcttgatttattcaattttgcaggggaagtcagtggcagagctattgatggtcccatttccgtctttgctccactatatctaggattatatgagttataggtagaagttggttgagcttgatttcatctgttgtcacctaaagcagaaacctgttttgatttataattttttttttttgagacggaatcttgctctgtcacccaggctggagtgcagtggtgcgatctcagctctatgcgacctctgccccactgcaacctctgccccctgggttcaagcaattctcctgcctcagcttcccgagtagatgggattatttttgtgccacgcccggctaatttttgttttttttattttttatttttttgagatggagtctcgccctgtggcctaggctggagtgcagtggcacagtctcggctcactgcaagctccacctcccaggttcacgccattcttctgcctcagctgggactacaggcgcccaccaccacacccagctaattttttgtatttttagtagagatgtggtttcaccaagtgttagccaggatggtctcgatctcctgacctccacctcagcctcccaaagttctgggattacaggcatgagccaccgcgcctggccaatttttgtatttttaatagagacggggtttcgccatgttggccaggctggtctccaactcctgacctcaagtaatctgcccaccttggcctcccaaagtgctgggattacagatgtaagccactgcacccggccttgatttataatttttattaatcgaaggtgagctgtggtcaaagcccaatgctgagtgctgacagagacacaaggtgagtaagatgtggcccctgcaggaggttgcgttctggtaagggagtatacttttttttggacaaatccttgtatagaaagggataaaaagcataggaattaagaaacaaattgtgagtgcaaggagcaagtgaccaggaaggattatgtgaaagagattctttaggcagaatatttagctcagaattatgcttttctagagtttaattgtaaatataatgcaaacctttactttacgagtgtgcctcatattattgctggtagataaaaatcaagaaacaggaaaagcatttcatctttacctttccgatttgatcgctccctaacaatccctgaacaaggtaaatcctgaatggtgataatcattcaaccttcatctctgctaaaagcatttcttttcctcccaggcaaaaacaaacagtgcctgctgtctagcactagttaaactagttaaacactgcctataaagcttatcttaaggaagagttataacagtatctgcttctgtttagcagttttctttttgttccagaataaaggtgtgattccaggtaaacagtaaagtttttagaaatagagcttccctattgtatgctatttttccatcagtgtcattatctggaagtgtttactcgtgttataagatctgtgtgaactgacactgcagtagtggtctctgggaacacaggtttttggaacacggagttggatctctagcatctccaacgtatatctgagtcaagtgattagaggctttttccctccttcacatactgctctctgactgagatgtgatctgtgcagttaactttgctgcctcctttccactgttgggtatttttgtccttttcttttgtttcttttttttttttgagatggagttttgctcttgttgcccaggctggactgcagtggtgcgatcttggttcactgtaacctctgcctctgggttcaagcaattctcctgtcttagcctcctgagtagctgggattacaggcgcccaccaccgcgcccagctaattttttgtatttttagtagagacagggtttcatcatgttggccaggctggtcttgaactctgtacctcaggtgggccactgcacccggcctatttttgcccttttctttcctattttctgcctatcttcttgaggaatttgtaaggttaaatacttatagttacaccttatacagtacttggctaacccttttcaactaggaagattatgatgcttaatcttaatgagccagtaattacagtatgtcttcatattctcacagacacactcaagcgtagagaccatgatggttaaaaataagactttcaaatgacaatatccagttcttagaagatgagaggagacggctgagcatggtggctcatgcctgtactcccagcactttgggaggccgaggtgggtggatcacctgaggtcaggagttcgagaccagcctggcccacgtggtgaaaccccatctctactaaaaatacaaaaattagccaggtgtggtggctcacgcctgtagtcccagctactcaggagattgtgccactgcaacagagtgagactccatctcaaaaaaaaaagaagatgggaggagacaaaagttctggttcttaaatactgtactgttgaatcaggcaaaaatacttacaaatgtagaaactgagactccaataagataaaccaggtttacaagtcactgtatcagcttggaggattcctgtcctcttctctcatccttggcccataaggaacattatgttcttgctgtggcttctcagtggtatgtattataatagacgtgtgtggtgtttggggaacttgtttaactagtgctagacagcaggcactgtttgttttcgcctgggaggaaaagaaatgctttttgcagagatgaaggttgaatgatgatcactattcaggatttaccttgttcagaaagctgtgggaggcaagagtagttaagttaggaacagctgtctggagctttacctcttgctttttatctcagccgaaggtaggtagtgattttttttatgtctaatgcatatggtataaactagcatctcataactccaaggtcttctaatatgagcagctggtttctctttagttagccctaagaggcctctgaaataagtcctaaaagtcccccaaataagaacattcctctcctgaaaaaaaaactttgttgaaacgaaagtattatatacttctagcattgatgaatgttacaattaatatacttttaaaaataaattttagactttctttgttatagaggctgcttctcttaaaagccttctcttggccgggtatggtggctcatgcctgtaatctcatcactttgggaggccgaggcgggcagatcatgaggtcaggagatcgaggccatcatggctaacatggtgaaaccccgtctctactaaaaatacaaaaaaactagccgggtgtcgtggcatgtgcctgtggtcccagctaattgggaggctgaggcaggagaatcgcttgaacccgggaggcggaggttgcagtgagccgagatcatgccactgtactccagcctaggcgacagagcaagactccgtctcaaaaaaaaaaaaaaaaaaaaaaaaaaagccttctctttgaaggcttagctctgtatgtcttaaacagcagttattcatgtcagttattcatgtaccatctgtgaatttggccacatcactgtaccacctatactattatttgcttagtattttcttttaaatctactttacatcaatttactccccctttatgaaaaattgaggaaccgtttacttacaacaaatagacccattttaattatatagtttgtgttttggaagttgtatatagtgatattaccaccagcatgatcaagatacaaagcattgacctggtgcagtggctcacacctgtaatttcaacactttgggaggccaaggaaggaggatctcttgagcccaggagtttgagggcagccagggcaacacagtgagactcctatctctataaaaaataaaaacttagccaggcttggtggcatgcacctgtagtcccagctacttgggaggctgaggtgagaggatcgcttgagcccaggagggtgaggctgcagggagccacgatagtgccgctgcacttggcctgggtgacagagtgagaccctgtctcagaaaataagtcccctacccacccaccccaaaaaaggtacagagcatttctgtctccctgaaaatgtccctatgtccctttgcagtggatccctgccctgctttctgtcactctagacctctttacccacccatcccatccctgcacccccgcctttttttttttttttttttttaacttagatttgtcctcaactgtaatgtctctaaattctgggatttgaggtgtgtgtttgtgtgggtttttttttttttttccaaatcacataaaagtgagagagagagagagagagagtgtgtgtgtgtgtgtgtatacatatatatatatatatatattttttttttttttttttctgagacggactctcaccctgtcgcccaggctggagtgcaatggcgccatctcggttcactgcaacctccgcctcccgggttcaaacgattctcctgcctcagcctcctgagtagctggggttacaggcacaccaccacgcccaggtaattttttgtatctttagtagagacgagatttcaccatgttggacaggctggtctcaaactcctatcgtgatccgcccgcctctgcctcccaaagtgccagaattacaggcatgagccaccgctgccagccaaatgtataattttttaaattcacactttggtgaactggtttaactgaggaaaagtgttgattcgtgtgttttcaaaagatgaaatttttttttttcccctgaaacagagtcttgctctgtcacctaggctggagtgcagtggtgcattcttggctcactgcaacctctacctcctgggttcaagcgattctcctgcctcagcttcctgagtagctgggattacaggtgcccgccattgcacacgactagtttttgtatttttagtagagatggatggggttttaccatcttggccaggctggtctcgaactcctgacttcgtgatctgcccaccccggcctcccaaagtgctgggattacaggtgtgagccactgcctaagatgaaaaaatttttaaagtgactagttcattaattcccaaatcttaggctctaaagacaccttttatttctattgtagttaccagttttggaagatatgataaacaacttttttttttttttttttttttttgagacggagtcttggtctgtcgcccaggctggagtgcagtggcacaatctcggcttactgcaagctccgcctcccgggttcacgccattctcctgcctcagcctccctagtagctgggactacaggcgcccgccagcacacctggctaattttttgtatttctagtagagacggggtttctactgtgttagccaggatggtctccatctgacctcgtgatccacctgcctcggcctcccaaagtgctgggattacaggtgtgagccaccgcgcctggccttgccaatttataattttccgttagcttttttgaaaagttgagagttgctccttgacctcctttaccatcttaccttgcatttgattcttgacttttcctccaacatttaaattgtcagaacttttaagcaattttaacattacatatgtaatatttcttctggtagtgagggagtattttaatatcccatactgtctgataaaaatcgcctagcataaaaacgattcttggccaggcactgtggcccacatttctaatctcagcactttgggaggccaaggcaggaggattgctcgtgaagccaggagtttgagatcagcctgggtgacatagtaggaccatgtctctccaaaaaatttttaaaaattagctaagtgtggtggcatgtgcctgtagccatgtctgctcagggggctgaggttagaggatcacttgagcccaggaactcaaggctgcagccagctatgatcacgccactgtgacagcctggacaatagagcgaggtcatgtctcaaaaaaaaaaaaagtttgtaaaaaatgctcacgaaggtatgaatagtagggcttgttttataaaatgagctaactattaaagtctcagttctggctgggtgcagaggctcacgcctgtaatcccagcactttgggaggccaaggcaggcagattatctgagggcaggagtttgacccggccaacatggtaagatcccgtctctactaaaaatacaaaaaaattagctgggcgtgatggcgggcacctggaatcccagctactcaggaggctgaggcagcagaatcacttgaacccgggaggcggaggttgcagtgagccgagatcaagccactgcactccagcctgggagacagaatgagactgcatctcgaaaaaagtctcagttctgtgacagtgagcatgcaattgaatggctcttcttaggaaaggagaattaaatcatacctatcatgcaactgtgttagataaaattgtagcaaaaatattgaacccacgtcatttatacaacagaattaactgtacttgaaatataatttatgaatttgtagagaggtaaaactgtgtctaaattctcagcaattagtatctatcagaaaatgtgcatgtagatatacccactctgtaaatgctttgttgcactttttttggttttgggatttttgtttgagacagagtcttgctctgctgcccaggctagagtgcagtggcgcgttcttggctaactgcaagctccgcctcccaggttcgagtgattcttgtgcctcagcctcctgagtagctgggactacaggcgcacaccgccacgtccagctaatatttgtatttttagtagagacggggtttcaccatgttggccaggctggtctcaaactcttgacattgggtgatctgccctgctttggcctcccaaagtgctggttttacaggtgtgagccaccatgcgtggccatgctttcactcttaaaaatgcttgggtttaagagttggtggaaaaaggaaaaaaaaaaaatgccctgatctggatgatgagtttacggccatctggttgagactgttgtaaagtagaaattttccctgtaaagtgtcactttcttcccaggtgaaaacattaatcaagcaaggataatctttaaaattaaaccttagttctaaatatgatttttgagtacaagcttttttaaagtgttgagttgcttcatttacttacttgataaaattgagaagcagtattgcccagtggttaagagcactggtcctagaattttacttagttttaaattctggctctaaaatgtactatgatttggggcttgtgaggaagtaatgtgtgtagaggcgttaattattagcacaatgcctggaatatagtaagcaacccagtaagtattagtaattataaggatcataaatctgattgaatatttactctgtgtctgaccctgcactcagtgctaagggattcagaaattatttgacattcttccgaggaacttgacatagaatactgtttttcctttgtttttttgttttttgagatggaattttgctgtcgcctaggctggagtgcagtggcaccatctctgctcactgcagcctccgcctcccaggttcaagcagttctcctgcctcagtctcccgaatagctgggattacaggcaccccccaccacgcctggctaatttctgtatttttagtagagacggggttttgctatgttggccaggctggtctcaagcacctggcctcaggtgatccaccaaccttggtctcccaaagtgctgggattacaggtgtgagccactgcgcctggcctgttttttttttctgccaacattatcaaacattttcctatgtactaactaatagacatctttatacatctttatacaattctttttttttttttttttttgccatacaggttcattttattgagtggaaagcttacaaaaggtccactggccccttccctccccacgtgacactcattccttccaatgcaaactctggtgtatccacactcgcttctgcgtcactggtttcccccaacaaggcacaaagggcgggtgcttccaaaggatcccttgctcctggcagtgggactttcagtgctgggtgtcttgtgcaaatggtggctgaaagcaggactgttagttcactcagacactgggatcttccttactcctgcagaggggcttggctccaggcccacagtactcgttgtagatgagcttgaagaggaagaggtggaagagggtgatgagggaggccaagctgaaccagaagaggaagggcagcccggggtcctgctgagccatgtgctcatcatgggccaggatggccttgaggtgcagcgtgtgccgcaggtcctgcaggtgtgtgaggtcggtggagatgtagagcagtggcgtgatgggctgtgtcaccatgaccgagaaggtgtggcccgtgggcgccgaggtcagctccactggctcgtccaggcagcctgccttgcaggcatagatcttgacaggctggccacgggactccacggactcgtgtaggtagggcttgccctcggcatccgccagcacggccaggttgatatggtcgttcttgtagcggatgccatgcaatgcatagctgttctgcagcacgtcggggtcggcctggaactggaggtggttctctgtgaactgcagccccccgaagctgagcaccatgccctgcaggatgcctggggcacccaccttcaccagccccttgcagccactcttctggagggtcagcctccacaggtcagagagctgcaggatctgctggacggaggacagcagccccggccacaggttctcggcgtgcatggtggcgtgcccgctgaagcggtgatcttcatagttgagcgtcgactccatctggtctcgctccctgtggctcagggaggggctgagcagcggggctggcgagcaggagagcatgtaatagagcgtcaggttcacggtgaggccagacggcctgtgggtgtcagtgatcttcatttccactcctgggctgaagagctgagcccagaggagctggtggtcttgaagcagctccgccgctggcatctccaagagctccagcatttccttccgtgccaagtcctgcagcgccttgagctccttggctgctttgcttttgggcacctgggggataatggggccagagacgtgcaccacccacagcaccgtctcatccagctgcgtcttgggagccacttggaggcggttcaccagcttcttggcggccaccaccaccaggtgcaccaacccagtgggcgtaggcggggaccggcctgagtagaggaggaactgatggtctccgaccttctccagggtactggtgaaggccttgggggctgggccggcagtgggccccacagtctgcagcgcggtcacgcgctccgtggggttgttgagctggatgcgctgcaggtagacgtggggtcggcccctgtgcgccagaaagccctcttgcagcagcacgcagtcgcggccggaccccgcggcaaggccagagacggaggcgggcccggggccggcggccacggggccaggacctggggaccccagctgcaggcaacgcacgcggcgcagcagcccctcccgcagcagcagcaccgcctctccagcttcagccagcgcgctcagcgggcgcagctgcacgaagggcacaaagtccggcgccacggcgggctcccgctccccgggagtcacccacagccgattggcagccacgtccagggccaggaagccgttggccaccagggccggcactccagggcccagcggtaccgcctcgccgcgctcccgcaggccgcgccaggcgcgggtggccgcctccaggcaggcagacggctcggtggcgcccggctcaccccaggaccagggaagcaggtgcaggccgcccgccgcccgctgcgcgccggaccccccaaaccacagaagcagcagtaggaggccaagcaggcagaggaggcggcgggcccagctgctcgacagcagtcccggcagccccttgagcccctgctgtagccacatcgggccgccaggcgcgggcaagggcgcgagggcggccgccgggcccgccgcccagcccaccggcccggccgcccgtgcctcactgcccggcccagaccgcggcgcccaccccggcccccgccgcaaccgccgcagcagccgccatcgctgcttcctcctccttctcctacaatttaattcttcatttaggtttgtgtctggctgttgccctggtgttgtttattaatgttgatcatacagctattttggcattgcccacagctattgaggataagaaatgtgatgaagaaagtggtagctgcccccagtagaagcttatgaagacgctgtttttagttttaagggatcagttaatctacaacttttcatagagcattcattggtttagatcttaatattatcctgaaactggataatactttatattttgaattatccaattaatgcaacaaacacgtgagggtctatggcattggagtcattgttcacatttattcacccaaacttaactatcagtgctgcttttcctacccacccactcccccctgggcttactccctgaagagcaagaatgatttatttatttttatttaattttttgagacaatcttggtctggcgccaaggctgaagtgcagtgtcgcaatttcagctcgctgcagcctccgcctcctgggttcaagcgattctcctgcctcagccttccgagtacctaggactacaggcatacgtgaccatgcccagctaatttttgtatttttagtagagacgggattttgccgtgttagccaagctggtctcgaactcctgggcctcaggtgatccgtcaacctcggcctcccaacgtgctgggattatagtcgtgagccactgcgcccggccagcaagaacaatttaaacataagccagtttacgtttacgtaaactgcatgtacactccagagtcagagattcacctggggattgtgaatctgcatttccctcctgcctttcagtttaagcatcttgtcattacacgggattttagtgtttataaatgcatgttcacacaatgtggcttctaaactattttgtgtgtatatatatgtattatatatgtatatagatatgtgtgtgtgtgtgtgtgtgtgtgtgtgtgtgtgtgtgtatttgttgttgtcgagacaggttctctgttgaccaggctggagtgcagtggtgtgatcatggctcaccaccagagcctcaacctcccaggctcaagtgatcatcccacctaaacctcccaagtagttgggactacaggcgtgcaccaccacacctggctgatttttgtactttttgcagatatggggttttgtcatattgcctaagctgtattttgtctatttttttttttttttttggtgacaggttgttgctctgtcacccaggcagtggcacaatcttgtctcactgtagccttgacctcctgggctcaagcaatcctcttgcctcagcctcctgagtagctgagaccagaggcatgcactaccatgcccggcttactttttttgtattttttgtagagacgaggttttgccatgttgcccaggctcatctcaaactcccggactcaactgatcctccttccttgacctctcaaaagtgctgggattacaggcatgagccaccacacctggcgtattttatctattcttaacagaaatattcattataattctattgaaagaaatagctgtgttgcatttagagaacagtatgttgatatccactctggcatgccttcctaagggattttcaggttaatatgacaattggagaattgagccaactttagacccgtggtctaaagagaagtcaaaattagtaggagtctgaatccttgccttcaagaagcttgtaatctaattggagagcacatttatactggaaagcacatctataaaacaattcacagtaaagggtgtaaggaatcatgaggataaatggcagccgcaacaactgcaagcattctgtcccattgtccccataaatacaaccaacattgtcaagcaacaagtctagatttttggtttaggaaaaaaggcatcagtatcattagaggggatgggaaagagcaaaagtggctttatctgtaaaggcttcctggaattattgacttgtaattgaataggtgctaggagagagatagataaaagtcatgaggatatttcagacactatggtcgttgggagcatgaaggtgtgaatcaagccaaactgtttatcatttggctaggtggtaggggacacacgggagtgtcacagcagtgaggatcgtcaggagcatcaccagctgactcaggggtgaagataaattctcttgaccatcatattcctcattctcttcactgtctgcactgaggcctttttcgagtgctttctgagccttctcatagttaaagtggtgaattttattgaaaacacttgttttaaaatttgtctattttatctaaaaatttggtcatggctaaatgattaccttgtaagcccttgtgggagccagtgtgatataatagaggtcagaaacaggagtcagggaccctaggttttggcacctcattgtcgtttattagctctatggccataggcaagtcgcttaacctctctgcatcttagtttcctcacctccaaaatgttagaccagaatcagacgtttttatgctatacttttttttttttttctttttttgagacagggttttactctgttccaggctggagcgcagtgacacaatcatagcttactgtagcctcaaactcccaggctcaagcgatcctcctacctctgcctcccaagtagctaggtctacaggtgtgcaccaccacacccagctaatttatttctcactatgttgcccaagctgatctgaaactcctggcctcaagtgattcttctgccttggcctcccaaagaattttttttttcttttcaatgacactttaaaaaaaaattttttttttaattttttaaaattatactttaatttttagggtacgtgtgcacaacatgcaggtttgttacatatgtatacatgtgccatgttggtgtgccgcacccattaactcttcatttaacattagttatatctcctaatgctatccctcctccctccccccaccccacaacaagcagcagtgtatgatgttccccttcctgtgtccatgtattctcattgttcatttcccacctatgagtgagaacacgcggtgtttggtgttttgtccttgagatagtttgctgagaatgatggtttcaaacttcatccatgtccctacaaaggacatgaactcaccattttttatggctgcatagtattccatggtgtatatgtgccacattttcttaatccagtctatcattgatggacatttgggttggttccaagtctttgctattgtgaatagtgccacaataaacatacgtgtgcatgtgtctttatagcggcatgatttataatcctttgggtatatacccagtaatgggatggctggatcaaatggtatttgtagttctagatccctgaggaatcgccacactgacttccacaatggttgaactagtttagagtcccgccaacagtgtaaaagtgttcctatttctccacatcctctccagcacctgttgtttcctgactttttaatgattgccattctaactggtgtgagatggtatctcattgtggttttgatttgcatttctctgatggccagtggtgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcaggtgagtagactgcaaaaattttctcccattctgtagattgcctgttcactctgatggtagtttcttttgctttgcagaagctctttagtttaattagatcccatttgtcagttttggcttttgttgccattgcttttggtggtttatacatgaagtccttgcccatgcctgtgtcctgaatggtattgcctaggttttcttctagggtttttatggttttaggtctaacatttaagtctttaatccatcttgaattaatttttgtataagatgtaaggaagggatccagtttcagctttctacatatggctggccagttttcccagcaccatttattaacaagggaatcctttccccatttcttgtttttgtcaggtttgccaaagatcagatagttgtagatatgcggcattatttctgagggctctattgtgttccattggtctatatctctgtattggtaccagtaccatgctgttttggttactgtagccttgtagtatagtttgaagtcaggtagcatgatgcctccggctttgtttttctggcttaggagtgacttggcaatgtgggctcttttttggttccatatgaactttaaagtagttttttccaattctgtgaagaaagtcattggtaggttgatggggatggcattgaatctataaattaccttgggcagtgtggccgttttcacgatattgattcttcctacccatgagtgtggaatgttcttccatttgtttgtatcctcttttatttcattgagcagtggtttgtagttttccttgaagaggtcgttcacatcccttgtaagttggattcctaggtattttattctctttgaagcaattgtgaatgggagttcactcatgatttggctctctgtttgtctgttattggtgtataagaatgcttgtgatttttgcacattgattctgtatcctgagactttgctgaagttgcctatcagtttaaggagattttgggctgagacgatggggttttctagatatacaatcatgtcatctgcaaacagggacaatttgacttcctcttttcctaattgaataccctttatttccttctcctgcctcattgccctggccagaacttcccacaccgtgttgaataggagtggtgagaagagggcatccctgtcttgtgccagttttcaaagggaatgcttccagtttttgcccattcagtatgatattggctgtgggtttgtcatagatagctcttattattttgagatatggtccgtcaatacccagtttattgagagtttttagcatgaagggttgttgaattttgtcaaaggccgttctgcatgtattgagataatcgtatggtttttgttgttggttctgtttatatgctggattacatttattgatttgcgtatgttgaaccagccttgcatcccagggatgaagcccacttgatcatgctggataagctttttcatgtgctgctggattcagtttgccagtgttttattgaggatttttgcatcgatgttcatcagggatattggtctaaaattctctttttttgttgtgtctctgccaggctttggtatcagaataatgttggcctcataaaatgagttagggaggatttcctctttttctattgattggaatagtttcagaaggaatggtaccagctcctccttttacctctggtagaatttggctgtgaatccctctggtcccggaccttttttggttggtaagctcttaattattgccacaatttcagagcctgttattggtctattcagagattcaacttcttcctggtttagtcttgggagggtgtatgtgttgaggaatgtatccatttcttctagattttctagtgtatttgcgtagaggtgtttatagtattctgtgatggtagtttgtatttctgtgggattggtggtgatatcccctttatcattcaatgaaactttttacaaataaaaactttactactttactcaaaaccctgttatacaaaacagagctgatctgctagggagttagaagccccaactgcttacctaacccttccttctcagagtcctcccagggaccttaaagctcaggagaacacagctggaaaatccctggactagatcccttaggtcccttctagaatgtaacaatttctgaatcttatattgataaatggagtggaatttcttaaaaacaattttgaggaggcaatgcagttttaaatacgtacgtattgtatgccatgctgtaacatattgctagatacagtgagcaataggaaaaggtaaacacagctcttcctttaagcagcacacttagaagagtaagaggggaacaaaagagctataacttatatatgatattatatgtattatatgtaatataatatataatatataatttattgttataacacaactcatactacatagagattgaagtcaacaagaattttctccctaaacataactacagagattaagaatagagaaaggaaaaggaaaggaatgcgtatgttttaattctgcaaaaagttcgggcacagtggctcagcctgtaatcccagcagaaggataacttgagctcaggagtttgagatcagcctgtgcagcataatgagaccttgtatctacaaaaaaattttgaaaattagccaggcatggtggcgagcacttgtattcccaggtactcaggaggctgaggtgggaggatcacttgatccctggaggtcaaggctgcagtgagccacgatcaaaccactgtaccccagcctgtgtaacagagcgactgcctcaaaaataatatttgtcaaaatagcttgtctttgtatcactgccacattgcttgtttgaaacgaagctgactcactttgttatcataagtgatcttaccaaagaccaagttgtccagttgccttggagtgtaggtcatgcgttgccggtaccctggggctgtgtacaatggccaggctgaggggaccttgtggttacccccatgggacttgtaacttgtcaagtgggaaggtggtaccaagtgaagaagggtagggtccttggttttggcctcacctggttcttcccagaatgaatggtgaaaaaattataattctgcagaaaaatttaaattctattttgtttactttttggatgggagataggtgtacacatggcactaaaattcaaaaggaacttaaggaggccaggcacggtggctcacacctgcaatcccagcactttgggaagccaaggcgggcagatcacttgaggtcaagagttcgagactagcatggccaacatggtgaaacccccccgtctctactaaaaatacaaaaattagctgggcatggtggtgtgtgcctgtaatcccagctacttgggaggctgaggcaagagaatcacttgaacccaggaggcagaggttgcagtgagcaaggtcatgccattgcactctagtctgggcaacagagtaagactccaactcaaaaaataaaaataaaaacagcggcttcctctaggaagtggggctggaagatttttactttttctgttatacttttgtactattgcaagttttaaaatcatgtatttcacagtaaatccagaagaaattatgcacttaatttttctgggtgaattgtgttatagaggtaatagaggattattaaaatttctttctttttttttttgtttcccagatagcagaccccacgttagctgaaatgggaaaaaacttgaaggaggcagtgaagatgctggaggacagtcagaggtgagtaggacagaggtgaccctgttcaacgagttcagcctgctgtgaagccagtggctctgggtcctttctgttaaaggtgcctcttggcttcacagtgtcacacacagctttggctgacttgaaaattggtatttgtcttgggtaaaaggtgccttgtaattaaaggattttgaaattgagaggaaagacttatactatttaattctgtctattaagagtttcatttacttaatatattgatttgactctataaatacttattatatattcaggtcatatagagcaccaagtaaacaagaagtgggtggaacttttttgttgcatattcttgtcttttccagaaattcaaacgatacctgaaactggaggcagggagatgtgataaatgtgtttgaaatcctgcctcagtcactgggaggttataggcaacatggtcatgtttgcatattcaggagttagaaatttggtatgatgaaacaaatgaacagctttttcttttctttaaattagaagaacagaagaggaaaatggaaagaagctcatatccggagatattccaggcccactccagggcaggtaggtggcactgaggatccatacctttagttaaggtgtaaatttttgtttgtttctgagatggagtcgtgctctgttgcccaggatggtgtgcagtggcacaatctgggctcgctgcaacctccgcctcccgggttcaagcagttctttcttgtgcctcagcctcccgagtagctgggattacaggcgtgcaccaccatatctggctaatttttgtattttcagtagagatgggattttgccatgttggccaggctggtttctaactcctgaccttcacctcaggtgatctgcccacctcagcctcccaaagtgctgggattacaggtgtgagccactgtgcccggcctacatttttcttaaaccagtgtcttatcatcattgatttatggttttagttttaatgaacacatagcaaatttaaatagacttatgtgcagtataacattagaaaactgaagtgtcgttggctggttggtgatattgctgcacctgctggcttctctccctctcccatttggaatttaatagatgctaagtacagtgggtcacatctgtaatcccagcactttgggaggccaaggacagaggatcacttgagcccaggagttcaaggttacagcgatctgtgattgtaccactgcactccagcctgagtgatagagacactctctaattttgagacagagtctcgctctgtcgccaggctgaagtgcagtggtgtgatctcggctcactgcaacctctgcctcccaggttcaagtgattctcctgcctcagcctcccgagtggctgggattataggcacccaccaccacgcccagctaatttttgtatttttagtagagacggggtttcaccatgttggccaggacggtctccatctcctgacctcaggtgatccgcctgccttagcctctcaaagtgctgggactacaggcataagccaccgcacctggccaaaaattttttagaaaaccaacaatttaatacaacctcatgagtcaaaagtgatacatggagctaggcaccgtggtgcacacttgtagtcccagctgcttgggagcctgaggcaggaggatggcttgagtcaaggagttcgaggccaccctgaacaacatggcgagaccctatcaaataaaataaaagtgatatacaaattcatcattataactggtgtgtcatacttagttcactcttgaaacctgtcatctatttggtagactgagttttattctaagaggtattttaatttgataagatttattgttttcataatgtaaatgaaaggaaaatgtcaaattacttattttttggcaactgaagcaaatctgtcatgtttgagtaggaggaaaaatagcaaaaaagtaagtagctgactaaaattttcacaagacattagcagttaatctgggattagtatcccagcccagcttccctgagacaaacttttttttttttcctgttataaccaggaaactgcacataagtaaacagtacaactcccttaaatatcctttgacttgaatataaattgaaccaggttgcaaaagaaaagtatggaggaaggatcacagtgtgccaataacacgctgagatactaatactttaaaagtcactcctattcgtagcatgaataatgctgatgtgaagctaggtgtgaagtgcattctcagctcagaacaggaggcaggccctataaaatctcctcattccaggcctactgatggaaaccaaaggttttaaggtttagtctcctaattccacggaagttttcccaggggagatactcccagcagcatctgtaattctcagccttaagccactgactaggaggattcacacttaggagtgctaccacccagcattcaagactagtaacatgccaggcacagctaagtgccataccttcactgtctgaagcctcccaaatccataacgtccggcttggcaagttggaatagcttgctcgaggtcatgtggcaggcagccagtgtgcctcaagggcccctgcctgctctgatctctacagtgtccaaggcccagagcccctctcacttgaagggcagcaccttggggacaattggtttggggacactgttttgatggcgcttcctttgttgaaagaggaaacctctttttagtctattctcattaacagacgaatagccctgcgttattcctgttgcaagttgccttgccattgcttgctacttcagccgttcgaattcttttcgtaactttccatctcctcatgtaatgagcatttcatagcaacacatcttggatagaagtaaaatgtttttatactctaagcagatctcaaggttcccagcttggggaagagctggtaataaatgaagcttgcattgttagaggctgttagtccaaacggacaagatccctatggaggaaaattagatataccagtggcattggagtgttctgtgactgtctagcattatactatactaaggatgattatatattatattttatataatatattttatattttatataatgtatagtatataatacacttatatattataagtacatattataaggcctttttgctcttattacatgcttattaaatattctctgtcttgtactccaagattcaaatgaaatgtatagaaatgttgctagagcaagactggtggctgggcaaggtggctcaggcctgtaatcccagcactattggaggctgaggcaggaggattgcttgagcttggtggtttgagaccaggctgggcaacatggcaaaaccctgtttctaccaaaaataaaaaaacggctgggcgtggtggctcatgcctgtaatcccagcactttgggaggccgaggagggtggatcacttgaagccaggagttgaagaccagtctggccaacatggtgaaaccccatctctactaaaaatacaaaaattagccgagcgtggtggcgcaagcttgtaatctcagctactcaggaggctgaggcaggaggatcgcttaaacccgggaggcagaggttgcagtgagcccagattatgccacttccctccagcttgggtgacaaagtgagaccctgtctcaaaataaataaataaaaataaaaagactggtgacatttattaaaatgaaactcataattaggtagaagatttatttaaccacaagtaaatttatatcggaattcagtttataatttgagctttgttttttaaaaagcataaactatataccacgttctttctcttatagttgcttaagaaagaaaaaaaaaacttgaagcaacgctagttgaatgagggaagtagcgggagagtggcgggggatgtgtgctgttcccatcagcccatcaactctttttattctgcagtgggcaagatatggtgagcatcctccagttagttcagaatctcatgcatggagatgaagatgaggagccccagagccccaggtaatgaacctggcagcttctcttttcaagtgtatgtgttcttgatttcagtagtgattgcgctctgacaagttgctcaaataagaagctatatttcattgagttacatatgatattaaaataatcctttttattttcagaaagacatttatattaatatatattttgtgaaatgaaggcatttattgaaattagatcccatagtttttatggtatcatgccttagagaggcgctggcagaaggactgaagagtgagtgtcggatgtctttctgctgctgtgcttctgcttcctaagaattgctgtagttgtattcattaggtatttagttagttttctcttcaattattttaaatttaatgttttgaaataagtaaaattattctcttggttcaaaattcagacaatgaaaaatgatatacaaagggaattttccttcctacctctatctccctaccatgttttcttctctagagacagacattaccagtttcttgtgtattcttccagagagattttatatgtattatacaccagcaaaatgtctatgcccaccctctctaatacataattactatgcatatgctgtgcatcttgcattttttcacttatgtcttggagttcactgcatattaatgcacaggaactttctcctttgtcagagctatgtgttttactttgaacagatgaaccatattttattttattggtcccctgtcatgttgcactgttacaaacattgctgcagcaaacaactttcgacatgtgtcacttctcatagaagcaggtgtctggaggacaaagtcctgaaagtggagttgctgtctcagacagtgtgtgcttttgtaattttgatagatcctgccaaatttccctccatggagttgcggcatttagcagtcccaccagcaatgtatgagagtactttatttccacacttttcacctgcaaaggcgttatcagactgaaggatcattgataagtgatattctgatgagaaatctgataagtgagaaatggtgtttcagcataattcgaatttgcaggttttttaaattatgaaccaagtgacgtgtctttttgtatgttttaagacccatttatatttctaggaactgtctgttgcccatgatcctattaggtgatttgtctttttcttattattcacagttaacaattgtaaactttttccttcttttttacagttattctttataaggaaaattagttttaattctatataaaacattttatataatcaattttaattatatataaaataatacctagtcccccatgaatttgctgtattattgcaataaataattcttatttgatgcatagacctgagatttaattcttttttttttttttttttgagatggagtcttactctattgcccaggctggagtgcagtggtgccatttcggctcacttcaagctctgcctcccgggttcactccattctcctgcctcagcctcctgagtagctgggattacaggtgcccaccaccaggcccggctaattttttgtatttttagtagagatggggtttcaccatgttagccaggatggtctcaatctcctgacctcgtgatccgcccgccttggcctcccaaagtgctgggattacaggcatgagccactgcgcctggccaggatttagttctttaaaaaatgctttcagctcattttaccttagctctaccctccacaattcttaaggctggtatttaatttttaaaatactttaataggaaattattttaaaacagtttgtaggtactcaatttaaaaagggctatttatctcctggaactcaaattataaaaatatttttctggccaggagtagtggctcatgcctgtaatcccagcactttgggaggccgaggcaggtgaatcacctgaagtcaggagttcaagagcagcctggccaacatggtgaaaccccgtctctactaaaaatacaaaaaattagccgggcttggtggtgcgcgcctgtaattccagctactcgggaggctgagacaggagaatcacgtgaacccaggaggtggaggttgtagtgagctgagatcgcaccactgcaccccagcttgggcatcaagagggagactccatctcagaaaaaaaaatatatttttttctccatctcaaaaaatagaaaaaattctcaccaaactatcactactgtttatgcattgatttgccttctgggccattaagtagatttcgagtctgacagatatttctgtggaattctgtgtctctaagttctatgtccttttttatggtttgactctaatactttaattttgcttaacagaatccaaaatattggagaacaaggtcatatggctttgttgggacatagtctgggagcttatatttcaactctggacaaagagaagctgagaaaacttacaactaggatactttcagataccaccttatggctatgcagaattttcaggtaaagacatgatgagtttccagtgaagacttttatgagtcgggtgtagactgaaagatcttttttctggagctgtactacttgggttcagatttccttctccttgaaaggggtgtttaacctctcaatgcctgtttcatcatctgttagatggggatagtattaatacctatttcatagaagcgttgtgaggattaaatgagctaatggactaatacatgtgaagggtggagaatagaagcacatatgtgtttgatagggtcagcagttatttatttgtggggtatctaattggcacatgtcggtagaagatagagcaatgatctggattcaaatacagttgtcccttatccttgggtgtccttgggggattggttcttgacctcccatcctcaccctatggataaaaaaattcatggatgctcaaatcccttatataaaatagcacagtattttcatgtaactgaggcacatcttcccatatactttaatctcttgattacatataatacctaatacgatgtaaatgctgtgtaaatagttgttacactgtattgtttagggaataatgacaaggaaaaaaagtctgtagatattcagtacagaggcacccatctttttaaatttctgaagattttttactcatgcttggttgaatccacagatgcagaacccataggttcagagggccagctgtgctttgaaaatattagcttgtgtttttattagaaagaaaactctgaggccaggcacggtggctcacgcctgtaatcccagcactttgggaggctgaggtgggcggatcacaaggtgaggagatcgagaccattctggctaacatggtgaaaccctgtctctactaaaaatacaaaaaaattagccgggcgtggtagtgagcacctgtagtcccagctcctctggacgctgaggcactgcactccagcctgggcgacagagtgagactctgtctcaaaaaaaaaaaaaaaagaaaactctgtcataaggaagatgaaaatgtgctatgaaactgaaatttgttttattctgtgataatcctggcagtactaaggaattacaacaggtgaaggattcagtaggagacataggactagtggcattgggtttatgctgttacttttatggagaaggaatgtttgcctaacttgagacatttatcttgagagaccctgactttcagtgttgggaaagaacttggccaagcaggagtataagtttgcccaactttattaaaggagcagtgttctgttgttctagtaaaaatctactgcctgtaattgaaattgtccatcctcctctaggagatggagcctcagcagattatagtaaaaccaaaagctagcctgactagcttttttatttttttgagatggagtcttactctgtcacccaggctggagtgcagtggcacaatctcggctcactgcaccctccacctcctgggttcaagcgattctcctgcctcagtctcctgagtagctgggactacaggcactcaccaccacacctcgcaattagtagagacagttgtttcaccatgttagctaggctagtctcaaaactcctggtcaggtgatccacccgccttggcctcccaaagtgctgagattacaggcgtgagccaccacacccagcctctaactagcatttttgacagttttatttactttggatgttttagggctgaaactctgctatgaactatgcctgtgttatccagtgctggccttagttcataataagccagaaccatgatcttcaggctttttatatctgagaattcctggtctctacttgttttcatagtttctgctctttatggaattgggtatggatggagggttattgtctcgctgcttggtaacctcagctgtaatgaggtgtcagccatctatgatgaggatgtttcacattcctgtcctctctgcctgataaaagtgacaattcctagcttgagaaaagaattgtctccatgattataaggttgacttatacaatccttaactagaaataagagcatattaatatgtatctcttaacagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttgctgagtgaaaagaaagatggtcttatatgcttttgtcatatttgtaaaaattactgaatttagaaataaggaatatgggatagattacccaggggcatccacagtcaacattttctcttttttcccagactttaatcgaagggggtgtgtttgtgtttatatggttgtatctggctcttttcacttattgttaaaacaggaatatatcattttaataataatttttcaaagtatagtttatttttaatgtcttcatggtattccttcaagtgaatatatagtaattaactgttgcccttttggacaactaagagtgtttgcattctcttgctttctgtgaccattttcaggtaatgttctttgtgtagtgctgttaaggacttctctgtgcataaagctcttcctgtattttatttagggttatggtcctcagatggattttcagagtcagtctagaattgctggatcaaagagcatgactttttttttttttttttttttttttttttttgagacagagtcttgctctgtcgcccaggccggagtgcagtggcgtgatctcggctcactgcaagctccgcctcccggattcatgccattctcctgcctcagcctcccaagtagctgggactacaggtgcccgccaccacgcccagataatttttttgtattttttttagtagagatggggtttcaccgtgttagccaggatggtgtcgatctcctggcctcgtgatctgcccacctcagcctcccaaagtgctgggattacaggtgtgagccactgcgcccagccgagcatgactatttttaaagttcatggtgcttctagcccaactgggaggactacatcgagataagacattgttaaccgtctttgccaagaacgtttgaaagcaaaaccatagggttggagggttcctcttttgtaagctgtaggagtcccagggggatgtatgggagacacttagtgacttttaaattgattctgagctgtgatcactggtgttaagaaattatgtcctcttcttgaggggtgtacaaaatggggagtttaataataatcctctgaaacgtgaaatgaattacttagtgtctactgcaagccaggctcttgcagacacaaggctgtttggggacaacagtctaaccttcaaaagatgtgtaagagtgttctgttgggaatggcagctggcagagcagcatatataagatggttatgttcacgttttttaaagtgtgtgtatcctttatacctatgtttttgtacctagaaaaatacgtaaatttatacctagaaaatatctgaaaggttatgtattaaactgttaacggggtggattggtggcttatagggtagggggctaggcattttcacttttaatacctgtattttttttgaggatttgttttacttgggtgtcacattcataatttttaatcctttaaggagaaaaatgtgcttattaaatttttggtctctgaatgctaccaagtcttagtcatacagaacaatatgctgcaactgtttacaattcctaaaactgtaaactcctcaaggacttggaggctaaacatgaagaatataaaattaagttgacaatcactgtctcctgcataacactgacttcacttctcttgagaaatgtgcatctgctaatccatatttattactttttaggggtgggtgaacccataaataagatactgttctttgaatgcctttagctggtgttatttaccagtaatgcttggagaaagaatccaaaattacccccactaaaatgctcacgacccagttgtttctgtgtttgtcaaagtgtttctggtatattctagaatataccaaagataattacttgaatcatttagaaaattttacattatatcctcttataaggcacttggaaattcacccttttttttttttcggcttggctttctaaatgtactttaacatcaatttataatattaagagttcctaaggagagagatttcttagaagaataatcgtgtcttgtcttagagccacagcctttcacaatctgaagtgaatggtgcagagagctttcttgtcaagtcatatgtttcttcctgcagctcggcttgcccttcccctgcttgtgccgtgtaccctgtaacactgtgtttggatcccagcatcagatggtgagttctacttttggtttgtaaaatcatgtgggattgtgttttgaaactgcctttcaaatgaagttctttttgctggcctccagataattagtaacttactcatgtattgcttggatccttacattgtgtaatatatgcttctgttaatatgtgaatgtccatgaaggttggttggtatataggtcaggagcacctggcttttaaggagtcttgtaattactgtatcacctgctttaagtagaaacatggcagctcaattaagcaccagaaatttcttctgaagctcctacttttaatgagttagcactgttgcctggatttatgaatgggcagattttgaaaatgaggttcttcattgtcatcatggaattgagttctgcttattttcagacatgcaggtgataaatctctccttaatgattccagaaggaaaaggaagggatggattttagagttttttatttcttttgtcaaggtagttttattttctagttcaggtacatcagtgagtaatagtagagatacattcttggctgttttaggagagttaagagaacatttcatttaaatgtaaatgtttaaaatcaaagaaatgttcctgcatatgtacagtttttacctttaattttgtttaactgatttttctagtcttcaaggaaaactatttgattttcacatctatgatgagagaaaacagaaaaattgtcaagagtaagaattgatttgacattacttttgagagttatctgcttcttttgtaagtcataatttttcattttatagcttttatactgggcacctcattttttaatgatttgttttggttccaggatgttgccttcctggagaaactgattaaagatgatatagagcgaggaagactgcccctgttgcttgtcgcaaatgcaggtaggtagcatgatgctgaatctaccattttgaatatataggagcgaggctacgtcctcagcctataaaagataaagtcttaagaaatgtgtgtgtaccacatgtttaagatagtccatatccacattgtagcaaaaactgtaatagtaaggttggctcgttagatttttctttaatcgttggtttgttttggaagttattttatgtgtgtgtatactttttcatttagatggtaaatgcttctctatcttctccttcatgtacttcttttccctgttctaaactgaattttattttatttttttgagatagagtctcactctgttgcccaggctggagtgcagtagcacaatctcacctcactgcaatctctgcctcccgggttcaagtgtttctcctgcctcaacctcctgaattgctgggattacaggtgcatgccaccacatctggctaatttcttgtatttttagtagagacagggtttcactatgttggccaggctggtctcgaactcctgacctcaggtgatccgcctgcctcagcctcccaaattgctgggattacaggcatgagccactgtgcctggcctgaatttttaaatgacacatttaagccaggtgtggtggcacatgcctatagtccctctactcaggagacaagcaagatgttggcttaagctcagaagttcaataccagtctgggtaacatagcaagaccccatctcaataaataaataaaaataattgtactgacgttgtaagattgttgtaaaaattaaacaagaaaattcataagatgtcacacttaaatatctaccttataggcggcagagcaactaccacttgctgctccatttatctcattcagcatcatacttgaaatctaagacagtgcaataaggcaaaaaaaataactgacagattagaaaggaagaaataaaactttgtttgcaggcatgattgtatagatagaaaactaaagaaaagctactggaactaatgatcaaatctaaaccattttctggatttttacatactagcaaagaagaattggaaattgaattttaaatgtcatttataataggatcaaaaaagatgaaaaatttatggataaatttaacaaaatatatgcaagatctgtacattgagaactaagaatgttactgagagaaattcaagaagacccaagaacgatatgccatacacacgggttggaagactaagtattaagtcagttcttcccaaactaatctgtagattcaacttgatccatcttaaaatctcagcaggctacaatttcttaatagaacttgatgagctaattctaaagtttatatagaaatacaagggatctaggaacagcccaagggattttgaaaaagaacaaaattggaagacttaccttgtcatacttcaagacttctgtaaagtagcaagtaagactgtgtgagattaaccaaagaaaatagagaattcagaaatagactcatgtgaagtatatggacacttcaggtttttacagatgcctgagtaattcgagggagaaaggaccatctttttccatcagtggtcttagagcttggatatccatatggaaaaaaactgaatcttaacccttatcttattctctgtatatataaatattaactataaatggttcatcaacctaagcatagatctaagacaataaaatgtctcaaagaaaatacaggagatctttgtgaccttaggttacatttcttaggatacaaaatatgtgaaccataaattgtactttatcaaaaattaaaagcattagctgtttgaaagcccctattaagaagatgaaaggcaagttacagactgggagaaatatttgcaaaacatttttttctttttttttttttttttttgtctttttctatttttattttttatgtttttgagatggagttttgctgtgctgcccaggctggagtgcagtggtgcgaccttggctcactgcaacctccgcctcccaggttcaagcgattcgcctgcctcagcctcccgagtagctgggattacaggcgcacgccaccgtgccgggctaatttttgtatttttagtagagacgagatttcgccatgttggccaggctggtctcaaactcctgacctcaggtggtccacctgccttggcctcccaaagtgatgggattacaggcgtgagccgccacactcagccagccactgtcccagtcctgtcttcttttaaaatttctttttcattcttttccccagaagctacaaaacatttgtttgacaaagaacttgtatctaaaatatataaagaactgttacaactcaataaggacacaagcaatacaattttttttttttttggagatggagtctcattctgttgcccagactagagtgcagtggtgcgatcttggctcactgcaacctctgcctcccgggttccagtgattcttctgccttagcctcccgagtacctgggattacaggcatgtgccaccacacctagctagttttttgtatttttagtggagatggagtttcaccgtgttggccaggctggtcttgaactcctgaccttaggtgatctgcctgccttggcctcccaaagtgctgggattacaggtgtgagccactgtgcccggcccacaatacaattttttaaatgaacaacagatttgagcagatacttcatcaaagaaaatgaaaatgtatagcacttgaaaagatgtttaacatcattagtcattagtgaaatgcaaattaagatcaccatgagacattactacatgtctgttagaatggagaaattacaggtggctcacacttgtaatcccaacacttgggaaggctgagactgcgagatcaattgccctcaggtgttcgagaccagcctgggcaacatggcgaaacccctaggaaatctctacaaaaaatactaaacattagccaggtgtggtggtgtgtacctgtagtcccagctactccagaggctttggtgggaggttggcttgaacccaggagagagaggttgcagtgagccaagattgtgctaccataccccagcctgggtgacagagccagatcctttcttaaaaaaaaaaaaaaaaaattctttaaaatataatgtcaggccaggcacagtgactcaagcctgtaatcccagcactttgggaggccgaggcgggcagattacgaggtcaggagatcaagacatcctggctaacatggtgaaaccccgtttccactaaaaatacaaaaaaatagctgggtgtggtggtgggcacctgtagtcctagctacttgggaggccgaggcaggagaatggcatgaactcgggaggcagaggttgcagtgaggtgagatcgcaccactgcactccagccttggtgacagagtgagactctgtttctgtaaaaaataaataagtaaataaataaaacttgccaggtgtggtggtgggcacctgtagtcccagctacttgagaggctgaggcaggagaatggcttgaacccgggaggcggagcttgcaatgagccgagattgtgctactgcacttcagcctgggcgacagagtgagaccctatctcaaaaaaaaaagaaaaaaaaaaaaaaaggcaaaaaactacagtgacagaagcagatcaggattttccagggccagtgaggagtcagggaaagggtaattatattggggttgatgggatttgggggttgatggaagtattctgaatcttgattgtgttgatggttacatgctctatatatttgtcaaaactcattggaccgtatacttacatgagtgagttttgttgcatgtaaatcatactacaataggccgagcatgagagctcatgcctgtagtcccagcactttgggaggctgaggcaggcagatcacaaggtcaggagttcaagaccagcctgaccaatgtggtaaaaccccatctctactaaaaatgcaaaaattagccaggtgtggtggtgtgcacctgtagtcccagctacttgggaggctgaggcaggaaaatcgcttgaacctgggaggtggaggttgcagtgagccaagatcgcaccaccgcactgtagcctgggcgacagaaagggtctctgtctcaaaaaaaaaaaaaaaaaaaaaaatcatactacaataaaactgcttatttaggccgggtgcggtggctcatgcatgtaattccagcactttgagaggccaaggcgggaagatcacctgaggtcaggagttcaagaccagcctggccaaaatggcgaaaccctgtctctactaaaaatataaaaattagctggttgtggtggcaggcacctgtaatcccagctacttaggaggccgaggcaggagaatagcttgaacccaggaggctgagattgcagtgagccgagattgcgctgctgcactccggcctgggcaacagggtgagactctgtctcaaaaaaaaaaaaaaaagacaaaatagaaaaaccacataaatattcactttattgccaacaggaaaaccatcacttcctgccttattgtttaaaaacacaaattcacccatattcaatcacatgataaactggaggggctgcagtttgcatgtgactgagtgacttgccagtgtgattatgttgcagatgtcagcagacacatgtcaagggttagtcaccagacattgccaagaaatacgaaaagagaatctgcatgcgatccaggcactaacacagcagtacgcttttattttgctggaagagcctgtggcacagcccatgcattgacatttgatcttgtttcagctaaactaaatgtgtctgttaagattttttttttttaatttgaggtagatttaggtatgaggggaaaaagttttcagcccttttcctggcatagaccttacaaaagaactactttctttagctgtgtttgttgaggccgttggtgagtgtttgaaatctttttagttggcttactgctaactggaaatttaggacggttgggggaatgcctgactcaacgttttaactaagctctctctgaaaagggatctccccagcaaaatctgtagtgcaatcaattaccaagggagcggctgaaagtgcttaatatgcttaagctggcttcagaatgcatgttctgtattacaaggaacctgggtggaaacaaaacaaattcatctatatgttttgtttgtttgttttttgagctggagtcttgctttgttgcccaggctggagtgcagtggcacgatctcggctcactacaagctctgcctcccaggttcacgccattctcccgcctcggccccgcgagtacctgggactataggcgcccaccactacacccggctaattttgtttttgtatttttagtagagacgggatttcaccgtgttagccaggatggtctccatctcctgaccttgtgatccacccgcctgggcctcccagagtgctgggattacagatgtgagccactgtgcccagcccacctatatgatttttataaagggcatatctaaatcaaaataatccaggaagtgacaataaaataaaaaggtggaaaagtttatcttggacaaatgctgacaaaatgaaagtaccatagccatattagtgtgggataaaatagacttcatattgatgaaagatgtaatctcctaaaagaaataacagttatacctgctgggcacggtggctcatgcttataatcccagcactttggaaggccgaggcaggtggatcacgaggtcaggagttcgagaccagcctggccaacgtagtgaaaccccgtctctactaaaaatacaaaaaaattagccgggcgtggtggccaccgcctgtaatcccacctacttgggaggctgaggcaaggagaattgcttgaacctgggaggtggaggttgcagagttgagatcatgccactgcactctagcctgggcgacagtgtgagactccgtctcaaaaaaaaaaaaaaacagttatgaatgcttgtgaacataactttaaaatatataaaggaaagctaaaggaaaagtctgatgtaacacaagtatatattgacaaaccacaatcttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatgtgttttatcctaggaacggcagcagtaggacacacagacaagattgggagattgaaagaactctgtgagcagtatggcatatggcttcatgtggaggggtaagccggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaagaatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaagtcactcagtccctcatggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttggtaagtttccactcactggggagggagtgggtgtggctaatacacattattggctttgggggcaaaatccagaaaaatacaggaaaaagtgaaaaatacccataatttcacttctatttcatttttttaaagagaaacttgtgagactttttttaatgacattttatgattgtataatattctgtcacaatttaattattctccatttatgaacttataggatgttttcagagttttgttactgaaataatgaagcagtgaacgtctttctgtgtttctaattatttccttagaataggttcccagatgtggaatgactgagtgggggagttttaagcctcctgatccacattgcccaataggttttaactttttttttttttttttgatatggagtctcgctctgtcacccaggctggagtgcaatggtgagatgatcttggctcactgcaacctccacctcctgggttcaagtgattctcttgcctcagcctcccaagtagctgggattacaggcatgcgccaccacgcccggcttattttgtatttttagtagaggcagtgtttcaccaagttggtcatgttgaactcgcgatctcaggtgatctgcctgcctcggcctcccaaagtgctgggattacaggcatgagccatcacacctggccacatttttttttttttttaatcgtagttgtgggccaggcatggtggctcatgcctgtaatcccagcactttggaaggttgaggcaggcagatcgcttgagcctaggagtttgagaccagcctgggcaacatggtgaaacctcatctctataagaaaaaacaacaacaaagaattagctgggcatggtggtgtgagcctgtagtcccagctactcatgaggctaatgtgggagggctgattgagccctggagatcaaggctgcagtgagctatgatcacaccactgcactgcagcctgggcgacagaatgaaaacgaaacctgtcacaaaaaataataataataatgtggttcttgataatataggtcagcgtgcaaaataaggtttaagtgatttctgctaaaacactgctgtcttgctcagctaataatggccaggtgtttgaggatgctcagagctaccttcgaagtggggagtctcctaggttctgggatgtgacccatctgggttttccactggcttttcctggctttgccactcctgagctgtgaacccttggacaaaccgaggtctctgagtgaagttacctagaatacttagctcacagagttgttggaagatcacatggataatgcaagcctagtgactagtatggcatctagcccacactaagtgggtagcaaatggtagctggttagttctattatgagattgcaatggctttgattaataaacctcttttggcttttttagactttagttgctggtcttacatcaaataagcccacagacaaactccgtgccctgcctctgtggttatctttacaatacttgggacttgatgggtttgtggagaggatcaagcatgcctgtcaactggtgagtagaagcctgacatttaaatgaaagactccttggccacagcagagacagaaaaacatctcatttctgtaccttccatccagagtggtgttgtctggattgactgtctcgtgagccagagactaatcgccctgcatgtaaatatttcttgttcaaagttctgggagaaagtgctgggttgtctgtcccagcatttgtgtgcagatgaaatcagatgaaaaggaacaccactgtcagcatgggatcagaaaagaagtcacagatgacttccaaggagtggagaagggtgcaaaaggtggaggggtggggagcgagtgttccccttgattgactgactacggtgagggaataggaaggttacaaggtggttatggagggcatggatattttataaaccagctggcttgggtttccaaattgcagggctcttggggacaattctaattctctctccattttaggtgtgttctaattgtgaaaaatatataattatgctatatttcagtgttttagagcattcaggcttctataacaaaataccttagagtgggtaatttataaacaacagacatttattgcttacagttctggacgtgagaagtctcagatcaaggtgccaggagattccatgtcgggcccgttcctcatagatagtgccttgcatgtggcctcacatggcagaaggggtgagcacagtcccttgagcctctttcagaaggtcactagtcctgtttgtgagggttccatcctcatgccctaatgacctcccaaaggcctcaactcatttgcgattaggtttccacataggaattttgtggggacataaatattcagatcatagcatttagaaagcaaaaaaacaggctgggcatggtggctcacgcctgtaattccagcactttgggaggctgaagcgggtggatcacaaggtcatgagatcaagaccatcctggctaacacggtgaaaccccgtctctactaaaaatacaaaaaattagctgggcgtggtggcgggcgcctgtagtcccagctgctcaggaggctgaggccggagaatggtgtgaacccgggaggcagagcttgcagtgagccgagatcgcgccactgcactccagcctgggtgacagagcgaggctccgtctcaaaaaaaaaaaaaaaaaaaaaaaaaaaagccaaaaaacagggtcatgtttactcagggttagagctgagccctccctaagctcagaagtgcgtcacctccattttcttacctgtgaaatataaattatatgacaaggattgccaggatggctcgaggaacgaatacaggtagagctcttgcagtagtgtctgttcatatagtaagttatgcacgtgggttgaaatctttgttttaaatatattcttggggagttagcacttcctcaagtatcatttctatatttaagaaacataggtggccgggtgcagtggctcacgcctgtaatcccagcactttgggaggccgaggtgggcagatcatgaggtcaggagatcaagaccatcctggctaacacggtgaaaccctgtctctaataaaaatacaaaaattagccaggcatggtggcgggtgcctgtagtcccagctacttgggaggctgaggcaggagaatggcgtgaacccagaaggcggagcttgcagtgagccgagattgcgccactgcactccagccagagcgaaactcagtcttttaaaaaaagaaagaaaaataggccgggcgtggtggctcatgcctgtaatcccagcactttgggaggccgaggcgggtggatcacctgaggtcaggagtttgagaccggcctggccaacatggtgagactccgtctctattaaatatacaaaaattagccaggtatggtggcaggcgcctgtagtcccagctactcaggaggctgaggcagggagaattgcttgaacttgggaggcagaggttgcagtaagccaagatcgtgccactgcactccagcctgggtggcaccatctaaacacacacacacacacacacacacacacacacacacgaaaagtatttgcgtagtgctctagcagtagtcccttcgttcatcatatgttaggatagttcaacagttttaagtatgctctgggctgggtgcagtggctcatgcctataatcccagcactttgggaggccaaggcaggtggatcacttaaacctcagagttcaacaccagcctgggcaatgtggtcaaaccctgtctctacaaaaaatacaaaaattagccaggtgtagtggcacacacctgtgatcccagctactcaggaggctgaggtgggaagatcacttgagcccaggaggtcaaggttgccgtgagcccaaatagcactactgcactactccactccagcctgggcgacagagtaggaccctgtctcaaaaaaaaaaaagaaaaaaagattgatgctcattatgtttacaaaagcactgcattttttgaaaagtgtctcactgtgctattagctcacttcttgagatgtggttcttaggaaagagaagccttagtaacttagtttagagacgacttgggcactcgggagattttttcaatatcccgtggctatggagtgcgggagaatgatgccattaactaccagacccttgaggtcagcacagctctggcatcttcctgcaggcagaaccgtatactcctgaggatttgaatgctgtcctgctgctgactcacaggctaataaatgcatgtgttaaattacttggacatttagcagacatggtgatctgtatatagccatgccttatagtccacagtggagcatacatttcctgagagcgtaaatcagcattcgcctcctcatcctcctcttccttctcttctccctctcttctttctcgtcttcagtagttattgagcattcacctcagtgtcaggcaccatgaagtactttcatgcatcatctcatttgatccctgcaacttcactagaatgtcagttccactgatgacagtgtattcagaattaattttctttaagaaaacaaaaaggaatttcttgaggggctttctactgtccagtactcagtgaatatctgttgaattaatatactccaatcccatgagttagatatgattagtgatgagggacctgggattgagacattagtctaatgacactacattctagaccctgtttctaagcacttcctgtattgcatatcaactcatttaatcctcacagcaatgtgagatacatactatcctccccattttataattgagggaactgaagcatagacaggttacatagctggtgactggcagatgaattgacttatccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttacattgcaaatacaacagatttccatgtcttattagaaactgcttttcttgaattactacatgtaacttgaaggattggtgaatatttacagttgttgaaatacaaaaacaggtggctgaacttagaaaccaccaagtggcaggtgactttgcctgacatccgtgttcacagacctccacagcccctggtgaaaaccacttcttcatgtcccacgtccatctaattacatgtgttattttttgtcatttgcagagtcaacggttgcaggaaagtttgaagaaagtgaattacatcaaaatcttggtatagtatataagttcatctgttttcaaaatataactttttttgaacctcagcaactttgaatgattttagaactttagaatgattttctccacatttcagtggaattgtggcagctccagtaaaaaaacaaaacaaaaaaacgaaacaaaaaacaaaaacaaaaaaacctgcttatatttatacagtgagtctgaagcgaagaaatttgaaccatacaatgtttaattcctatggtgcttttcatgtacttcatttattgtgttaaagttcagaattgcacaaagataaacaccattgacttcagctgcccaaggccttgggcacactcttcttcccaaaatgaaaagtcactttgtgcctcagaatgctttggggttctctttctgcaaccttctgccatcagttttcatttgcatgaagtgggagaaagagaaaagcaaatggccctgctcttgtcttctgatatcttcctgaagtgaatccaacagattgttccctaggcataactagacaaggaaataaggacttaggagagaatggggatcagttcaggtttgaaagtttttgtgttttgcttcatggtattttagaacttcaggaaatatatgtcaaattctgatttaaataggttcattgagtgtttctttgacaattctgcaaggtatgcttaagtttaacatttgagtgtatttggggttcaagtcagtaggtttatttttcttttagaacatggtttggtttaaatacaaaaagtagccgcgcatggtggcacacgcctgtagtcccagctactggggaggctgaagtgaaagaattgcttgaacccgggaggcggaggttgcagtgagccgagattgcgcctctgcactccagcctgggtgacagagaccctgtctcaaggaagaaaaaaaaatgcatggtttggttgaagggggtgtggctactctgccttctgagtgggagtctggagccagttgacccgagttctagctcagtgggagttctatccttggacgaggaagtggaccactggagaagcagaagggatgaatctaagttcagaggcctgggctctgctctgagcagtgccacagggtggccctgtgacattgagtcattttctttccaagcttgactgtcaaatgaaagtatgccggttggtctcctctgattgcaaacagagaagcaaattatggcctagattgagcaagctgttaagaatccaggcggtgctgggcccatctgctttcctgcccctgccatgttgagcgcacttggcttttcctcagtcatcgctgctcccttattctcaaattgggggacccagtggtgctagttaatcaccagttgttttggagcatctctgtaggccacactggcccaggcagaaagcctgctctgtcccttcttccaatggctgttttttcagtagaggatacaataattggctaataccatgaggcattatggcctgtgagtcctcatcatcaccatcaccatcaccaccattccagctgctgcttgtgaaattcatgtgtggtactaagtaccttacatgaattatttcatttaaccctcccaacagtctcctttgtatgtgctgttctctctgcctggaaacactgtttcccaccccccgtccccaattcttctgtttatttttttttgagacagagtctcactatgtagcccagactggagtgcagtggtgcgatcttggctcactctaacctccgcctcctgggtccctgttcaagcagttctcctgcctcagcctcccgagtagctggggttacaggcgcatgccaccatgtccagctaatttctgtatttttagtagagatggggtttcaccatgttggccaggctggtcttgaactcttgacctcgtgatccacccgcctcagcctcccaaagtgctgggattacaggcatgagccaaagcgcccagcctccccagtcccaattcttctcatgactggtttcttatctttcagatcttaattcaaatctcacctcttcagaaaggcctttcctggccaccctaagatcatctcccaccgtcagacatcactccatccccctgggtcgtcttcatcactcttactactatctgaaatcaaatctgtttgttttttcctatagaaggtttgtaaaggccttatacagactcaccactgtgcctcacctgggcattaacacccaagaccctagccctgaaagcccagtgccaggccccagacatgctcccatcccctgccactcagcttacagtcctctttctgtttcctcttctttgtggattcacctttttttgggtgtgagcccagccatggtttaacctttttttggttcttggttatatttaatccagtatttcagatattcagaattgacaacttcagtgttcactcagtctatcacgttactagaaccagaagtgtctccaaccctgtatactatttcttacacacattgacatttgagaccactgagttcaaagaaagaaaagatgatcataatattcatagcagtcttggcactcacctcattctgccatctcctagctgaggatgggagaatgggcggattattttgttgcctttttgttcctccttgcttattgggcgtgcgcccctatttaaatattaagcaccgcccccctgccgcccgccgccgtacctttaaaagtatcacgttttatttgtctctgtgaaagttaaagatgatagatgtgaaggcacttagcacaggactggccccctaaataattggcagatttgaattcacatcctgcttggtatgaatactgtccacacggtcctttgaaaagttagtagaaaagatcttgggccactgcttcttgtctttccaagttagcatttcctgttgcggccctaccagtgagtcatcacactcagagccttggaacataagttttattactagagctatagtactgggattgttggatgcttagagatcttccccctccagggccacccacactcccctacagtaccacagagcctgccaaggacatggatgcttacggtaccctgaccccatggcttgaccaagtcagggtatactgtttgatgcaaaacaggaactcgctgctggattatcataatacataatgcagtggatgttttcaactgttaggaaacccactaatgaagttagtcgtcttcggcctgtctttaataataattaaatatattagaaaatacacagatccagttctcagctgtgcttgtctacatcaccagcaggacttgcatcttgttctgaaagttttgcaaaggggaggaaagtacttgttgccccctctttttttctatgagtatgaaaaattctagttggccaggcacggtgtctcacgtctgtaatcccaacacttggaaagccaaagtaggaggattaattgaggccaagagttcaaggccagcctggacaacatagcaagaccccatctctaaaaaaaccgtttaagtttcaataaatcctgcataatttctgggattcttgaaagcatgggctctctccgcactgagtctagtttcactgcttcttactggttttaatctttaatgttagacctatgtttatcccttattaaaatttccccctgctttaatttcaatgtaccagggtcaaacatcttataattcacagtgtactctcaaggctggctcatagttattttttaaaattttactaaacatttgatttttctctagcaactgaaattaacctctgaactttttagtgtgtttatttacaaatagagcatttctaagcgagtttttgaactcagcatttcattttgaaggcgtctggagtttaatgttacttggtgatatgagacttccattcttccaggtggaagatgagctcagctccccagtggtggtgttcagatttttccaggaattaccaggctcaggtcggtgaattttaaaagagggttattttcatatctgtgttaaaggctttgaatttgataccatttcaagttaaatagttcaaaatatttttattgctgacaatcttcagtcagcatttcagaaaaatgtaataattttcatgaaaactacagtccgaaacgccttagcaatttgctgatagtttgcggtgattaaaccaggggttcccaaatgccagtccctggaccagtgctggaatggctaagaaagagttgcttgaacataaagatttgtgggtcttacttcccacatattttgagtcaataggttgtgcccaggaatctgtatcttaaagaatgacccaagtgccaccagtctagtccagggcaccactctttttttacctggttggccattgtcccctgtcaactgacctctgactttcatacattctacacagcccattccagaccattctccacctggcagagagggttataagtggaagtcacatggtgttgaaaccggaaaggttcccttgtccccctcgcagggcatgtgatgggggtgtggctcgcttcttcagtgccccgctgctgctcagacctctaggagagcatacagacgggcaggctgtggggctccgaccccatggcagcatctgggggtgaatgttttacagctcctaaggctccagcgggcatgtgttacagtgtgctcttttaatttagccgtctgtaggcagcttgttttagctcacttagacccccttccttatcacaaggacagagggattaatgtatcccaggttcttgtcttggtgtaccggaagaatgggatcacatgtgggcttggagaatgagtgcaaggttttattgaatgaaagtagctctccgctgatgggggagccagaagggagacagatttcccttggagttgggccgctcagcggccctggccaaactccgcctcgtccccgtggttgatggcctgctggcttgccggggcctgtcggggtgctcttctgccggcctgctctccatgaccagccgcttgtgtctttttccaccaatgtgttcctctggccatccagccacttctgtctgcccactagggtctcaggtttttataggcccaggatggtggtgtggtgggccagcgtggtcttgggaaatgcaacatttgggggaaggcaggagtgcttgtcctcacctaggtccgtgggggtagagtcctagccagggacccgcctttctctccccagcacttcccttccccgcttctgtgtcatttaaagggaccacgctcttcccttcccagcactcccgtatcagtgtcacttccctgcccagagcccctgggtatcttaccatttcggtcgaacaaaggccaggctctcccatgccccatgaggcctgcacactctgccccgaattcgcttctgccttccccccttccactctccctcttgttcgttgtgcctcagtcagaccagtcttctccgcgctccagaacactctgccctttcctaccgcaagggcttaacactcggcgttccctctgtcttacacacatttctctcttctggtgccagctcctcctcaccatttcggtctccactaagtatccacatcctcagccttccctgcctatcgtgcctgaggggactccatcattttctatcagagcccccagcttcacttgtgacactaacaaccacatggagtgattttctttctttatggtctgtttcctcaactaaaatgtaagctccaagatgacagaaaccttacctgccttctgtcccaagtgtcgggctctgtgcctggcacgggttggcacccactgtgaggcctagttagatgatcgtggcactcacagacctcgcacggtgcttggtaaactagttagtaacttaaaacaattgctgtttccccttgaaatcccttgaaagcaaaccttttcaaaaatgaaattaataattctgtcttatgtgaatgtattcaagtgttacatagatcacgaggaaaaagaaatgtagcccttctgtcagataatacatgagaattcagtaatacgagtcagtgccctggggctaatattgggatgggaatgatgtggggtttggagggtgttttttttggtcagccgtgtttctgggagtgactccctttctgtgttttggtgtcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgcgttaccacctcacgagctgggtcacctctggcaagtccttctggcattgctccctcactttccttgctgctgtataaggctgtgagacaacaggcaaaaggtgggctgcagggcagctgcggtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcagttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcaggaatcagctctccaggaggctctttggtctggggccgaggggatgagggtgggtcctgaagacgtctgagtcccttgttacaggagggtgttcattgtgtcctcctcacagctgggagaacagctgaagcagctggtgcctgcaagcggcctcacagtcatggatctggaagctgagggcacgtgtttgcggttcagccctttgatgaccgcagcaggtaaaccaggcttggtggacatcccttgcttttgttctggggctgctgggtagattagcttgcccttatgatactccattctcctagagttattagcagctctttttggaggggcattttcttttcttttgggctaaatttaggtagattagcattcccatgtaacttaccagaatcagaatgagaattcagaagtcacctgaattggccgggcatggtggctcacacctgtaatcccagcaccttgggaggccaaggcaggcagatcatctgaggtcaggagttcgagaccagcctggccaacatagtgaaatcccgcccctactaagaatacaaaaaattagccaggcatggtggtacacacctgcagtcccagctacttgggaggctgaggcaggagaatcacttgaacctgggaggccgaggttgcagtgagctgagattacaccactgcactccagcctgggggacagaggagactccatctcaaaaaaaaaaaaaaaaaaaaaaaaagtcatcacatgaattccttttttgttgttgttgagacagggtcttgctctgtcacccaggctggagtgcagtggtgcgatcatggctcactgcagccttgacctcctgggctcaagtgatcttcccacctcagcccccgaggagttgggaccacaggcatgagccaccacactggactaatttttgcattttttgtagaaatggggttttgccacgttggccaggctggaattcctatattttgatgtcttgtgactctcgattttccactacaagggttctcactccccactgcacattagagtcatccgggagctttacacacaaccagtggccgcccacccccagagattctagaatggagcctggggatctgtgttttggtttttattttttttttagaaacagggtctcatttgtcaccctggctggaatgcagtgtcttcaccatagctcattgcaacctcgacctcctgggctcaagcaatcccctgcctcagcctcccaaggagctgggactacaggcgagcaccaccacatctatttttttttttttttttttttttccatagagacgtggtctcactctgtcacccaggctgctcttgaactcctggccttaagtgatcctcctggctcagattcccaaagcactggccactataaggattgcctggccacagctctagatacttagtctctaaaactgcaaaagtaagccagtgagccctgaggcccggcgctgtcaccatctccctgtccttcctgtgtggggacagcagcccaccacagtacttccctttctctcagtcataggaatgtacagaatctgtggttgcctttttgtgctgaacctatggtgtgatgtctccagcctgcctgaagtaggcttgctgtgggaagagtgatttctaacactggagtatgtcattgtgggccacatctgtgagagaaacactccacacctgctacagccagctgtgtctgtttctaaccctaattcttccatatctgtgttgagggcctttttttgtttaaatctccatggctcccggtaactggagtacctcgagcttttgaccttcccagtagtggaagagggagccctgccctcttgtcattggccatctcgtgagcatttctctgacattgtgaacatcttcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtaaagtcttggcctgccgcttgatgttggagacttttctgtataaagaacatgagtgggtcattttctgaaccaccttagaaatccaagatgaacgtgtagtcacaatatgcttaacgaaaatgcaactcggttttctgggcatttacaaaagcacagtgcaagcaggcaatttggccagcgtggcgctcagggaggggagttgctgaatgttctgtctgtaggtgccgactctcagctacctaggagaagatgccaacaggtatatatcactcactgagaatggttactatccagggcatatagagaattgcaaatcagtaagaaaaagaacccagctctcggggagagaactgggtgcagtcctatggctgctttctcgccttcagaggtgaggcaaacctctttttgtattgcccatgagacttccagaccttgtatggaactaaagacttaggctttcagctgggcacggtggctcatgcctgtaatcccagcactttgggaggccaacaggagcatagatgacttgaggccaggagcttgagtccagcctggacaacatggcgaaaccccatctctagaaaaaatacaaaaattagccagaggtggtggtgcacacctgtagtcccagctactcgggaagcttagatggaaggatcaactgagcccaggaggtggaggttgcagtgagccaagatcatgccactgcaccccagcctgggccaccaagtgagaccctgctttaaaaaaaaaaaaaaaaggctttcctgtgactttctctttactcctggcacacttccagaaagtttgtggtctggagacactcgcagtagctcttttgcccactggttccactgcattgtcttgctaatatttagaggtttctaatcctgtatcagaagagacatttgatcttttaagctgaaatgctgtggtttgatgttgttttaggtatgaacatgctaatgatgataagagcagtttgaaatcagatcccgaaggggaaaacatccatgctggactcctgaagaagttaaatgaactggaatctgacctaacctttaaaataggtaactgcttactttgtaagtcagctgtggggtttggaaggacacttggtaaccggctttgaagacgacggctcatcccttagcgggctagcgcctctcgggctgggttccaggcgaagatgcggttctgagacctccctccccttctgcagccttgccaggcctttctctccgcccttagaatctccatggaggagacccctttgtgtgtggtcaggaccctgaacaggagagtaggtccacgtctcacccatgacagaggactgagaaactcaagtttgtctcgttacctttgcaggccctgagtataagagcatgaagagctgcctttatgtcggcatggcgagcgacaacgtcgatgctgctgagctcgtggagaccattgcggccacagcccgggagatagaggagaactcgagggtccgtagcacccatcagtgttcattcctcttctgagttttgtcccaccaaacagcaggggccacgaggaaagcagctgcccttgggatgtctgttcgttgtctctcaaagtctgtcaatgtttcctgtaagctgggccttgtgccaggtgtcagagatgccaagtaggtttgacacagcccatgccccagtgatctcacaagctcagggggaaagatccacatagccacgctgtgtagtaaccctgccttagagaagagggcgggtagctggacactcaggcagacacattcacccctgccaccaaggtcagggaggacttctgctctggagctgtgtcctgagggtgaatgaaatgggctgttgtatgtgtggttccccctacaccccttccctatagcacttcccaccaggaatagacctactgctgtgggtcccttagcatggaggaccaggatacaaggctgataaggtatcctccaaacagatgattacttccctaaaaatcactcaaaaggagagaagagggaccaaggtaagactgctctgaaaggagagagacacgagccattggacatgcggccgagaagccagcttcattcctttctgggtggactccttaaggtttctttccagcctgactttatgacttctctgttttcaagaatacgtagcaaatgaggctggtcaccaaggtgtgtctgcctaggcctctatgagcatgttatctgcttgtctttgagtttctgttcgttttacgccggcttttcaatgcaggatttcattgacctgcttttgaaaaattccctcagtgctgtgttactagctcttctgggccccaggtgagaaccttaaacaagtaatgtctttcttggtcttgccacagcttctggaaaacatgacagaagtggttcggaaaggcattcaggaagctcaagtggagctgcagaaggcaagtgaagaacggcttctggaagaggtgaggcccccgatgggcagcaggctgggggagccgccgtgaggccaggtggccctgaactctggtcctgtcttgcagggggtgttgcggcagatccctgtagtgggctccgtgctgaattggttttctccggtccaggctttacagaagggaagaacttttaacttgacagcaggtaggacggcatagcctcttcccaggtcttgctgaccttgggaggtttcaccaaatgcccttgggtcccaacacttcccactgagaatcccgccctggttcccgttcttcatcactgggtgtgggccggacatctgaggagacaagttctggtgtgccctgtcctcctccccaccgcaccctggcggctgaaacagcaaggaagcagctacccactctccacagctgtcaccaccgcaaggccatgaggacacgcccactcagccgtgcagactctcagggtgctgtgtcttgggcattttggttcagggttaatacttcttgtcttcatgtgtgttctgccccagcagaggacagcttttgcaagtggcaatgcagagactgaagcatggagtgctggcacggtttattttgaaccaggcagccagcaagcgtttcagccgctggaatgtggggagggtgttaacagtccgtgactcctttcctgttctaccaaggaaataatttcctacactcgagccccttccttcattctttcccaggaaacgatgactccattgtcatgaaagcaaaagataatctgatttctaatctgccaagccttagccttcagcaaaaaggcacccacttcttgtggctacagtacgtttccctgttgggcctggctccctgggtgtgcttacgccatactgctggcggatgctggcggtactggccctgtgaggtggctttctctagctcacggcacattcataagtgcccttctctccaccagtctgtggcaggctcagtggctggaaggaggttattggggagcaaggctgtgtgagggcaggtggtgtcttcaagggcagcctgtgcctgtagcttctacccagccctctcctctcccgcaggctctctggagtccacagaacccatatatgtctacaaagcacaaggtgcaggagtcacgctgcctccaacgccctcgggcagtcgcaccaagcagaggcttccaggtaagtgacgcctctgcaccgagttcaggtaacaggtttcccctgttgactgttacttgcgtttgttttctgggttcttgaactccagaggtctatttctcttaagaccaactactaccatctctttaaccatcttggtagccgtgggattcagccttgaagaaatcccacggtagtgcgctaaggggaagttggggtcttgaaagatgacattgtcactgtggtgtttaccctcctgggcgtttcctaatgaagatgaccttagagttccccggcctggggagcatgttggtgtcaagctagcagctctcggttttctcatctcctaaaacacctcagagccagtaaaggtttctgctgaagctgtgttgtgaaataaagcaattatctgttgcagagacagcctgtgttgcagaagtatcctcactgagtttcagcgcagtctgtctgccctttctgtaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgttaagaaatgaggtggcctgaattagtaagaaaaaagttgattgcttactgctttacccacacacatttccatctaggacttgacatatccccatttgatatacaagttaaatggggtctgtcaatggcatccaaaaagttactacccgccaaagggaaagcagctatgacctggtctaaaccctttttttcttacagatggggaaaccagggtgcagagatttaagacttacccagcctgtaaactctcacctctagtatttgcttgtcatcttggtgcaaccagaaatccacatgtggaaatggtgtccaggagtacggtcctatacgaagttgttctgtctctgcatcataaatgctaatcatctaaaaaagaacgtgtcaaggatagaatttcaggaatgtcacccacttttcaaaccctcccagtaacgcaagctccagtgtagtcctttcatgcatttatctgcctaagcttcttaaaacctgtctcaaataacaaaagctgccagctactgaacacgtccagtgtgtctgcttctgcacactgtggggcacgcacgactgctgagcgccaacagcagtcccacaggacgagggtgttttttcccatttggggtgaaaacttgaggctcagagaaacaaggcccatttcccaggttacgtgtccagtaagcctcagagctggacctcaaacccaggcgcttctgactaaagtctgtgttcccattgcctcattatttataccccaaacaactgatcaccttgcaatttaaaagcatacagtgcctgctgccccatcaaaagaagaagctaatttgccaaatgatccagtccctgaattcccaaatttgccaatggcagcctcagcttacctagcaatattcactttggtaactgacactgaaatatgttctgaatatcaactaaactaggcctgttacactccttgagaagtcctaaaaatgttaaaagggttggctccgaatccaaacacatttcccagtgaaaacatcagcatttcataaatgagaagatttctttggggtggcctgaatgtgatttccgttttttcacactttgagcatttttaaagaattctttcacccattcctcaaatggcatataaaccttgggttttcagttttctaacttttaaaattacagtgtaatttaattaagcaccctaagggaatcagactttaaattaatttgatcattattttgggttaattaaattgttccagcaaattgctcttcagtgacccggtccaaaagaatgcatagtcctgagtgcagaggggagaaacctctctcctgcgtcccagttctcctctctttgtagaactttatagaaaagctcttacaaagtaacagaagtttgttctctttgaattcggatgctggggttcacacttacctcccacaccttttaggcagagaactggagctgatgacctaaagatgttcattactattttgagacagcaagtgtggggaggggtatatgtatgtgctggtccctgataatgtacggctataaagaagctgacagcataaacttttctaagatcccaaaaacttaaggccttgacatttgatgcctttttttttttaaccccttaacaaagatgatttgaaactcactggtcctcctgctaaagttcgcgcagcacgaagctgctcctccggaccccgatcttgaaaggatgctctgtaaatctctgcagtcttaatgttgacagctgtgagggacaacaggatgactctgaattgacaaaagaccaaagcggaaagtctgcacagtcttacatttctaccaccactcctaagagaaagataggaaagtgaacagaatggctcctaagtatctggacttccccctccctggagggggaaaatgcaacctttaccccaagcatctcggtgaaaatcgctgaggctcgagctggactcggtgagattttgttctaaaccaagagctgctttccacatgggaggcagccattccttcagtcggacatgtagcaaaacctctggtcatccctactggtgtacggccaggggtggctgggtgaactgtgatcgttctgtttgaatcttcacaatttagtattttatacatacacgaagttacagagaatagaacagtgaacactgtgtacctaccacccagctaaatcaatcaagtatcaccgctacagcagaagccctcggaaatagagccgattccatgatgccttttccgcgggagtcctggggctgccaagcagggaggatggttctaggttttctctagcctaagagttttacactttggaggatttctgttctcaagcaaaaccttcctcagttcctgatgtataaaaggattccagtgcctgccttcctcccccagagcactggcaggagaaaagcacgccgggcctggggtgctggggggagagggaaacaaaaccaggcactttcccagctcctgggaagggtgggcatggcctgtcctttctatttgctaccacgttgcttcttcaaagtcttaagaagtgaatgttatctcagttttataggtaaagcttagagaagttaagctacttgcccaaggcctcacagcagatgttcggagtagctgggatctgaacccaaagctgtcccatcctgacagcagtggggtcattggtttgctgaattagactttaactgcacatgtgaccaagactccaacccacaaaagatgcacactacttaccaatgccatatattactggaaagtggttttcgttttcttcccggtcatttaattctacaaaataagaatgtttaagatacactttttaaagaaataccaaatgattatttttactttgtataataaaggcgaaggaggagctcctcgatgcagaaagggaggaaaattccagaaaatgaaagggattgtggccctgtttccctaccctgtcccaaggcaggggggtttatactgaacaaactggcagctgcagaatcggtccccactcccaccccaccttctctgtgcaccctgtctgccacacgggtggcagctcctctgagatccagtgccctccttcctggtagacgagggggctgcactggaactgaggctcggcagatggtggacgagggcaaggggaaggggaaggccatcccaccacaggaagagccggaacagatggtggccaagcagtgacagcagtgtgtgccggtgcttgggcccactgcaagactggggacaaaacggtcctgagacccacatctttgctttggggcaaatggcaggacttacctgtcacacataatgtcactaagtgaatgtcatcttcttgcctgtcaaattcacctatgatgagaattttaagaccagaagtcagaaaagttcctctagttaccagaacaaactgctgagcaagccaacgacagggagggacggcagccaactgagtgtgctccgccctacagcccgcgcccacactgccacagcctggcctatggggccagacactagggagctgacaccacagaaccctgaccgccaggagatggccacattctcagcctcaggcccgaaggagcctgggctgagccttcccatttttctcttcattctgagagttttgcggggacccatggatttataagatttttacttttctcctaactaaactgttttcctgattatcagaattacaaaaacaaaaatctggccactgtaacagatctgaaaaatacaagagaacataaggaagtcggtttttaatgtccataatcctaacactgttaataattagtgtattttcttccatatttttctaagctcagcagagctgactataaagacaattttatatcttttttttttttttttttgagatggagtcttgctctgtcacccaggctggagtgcagtggagcgatctctgctcatcgcagtctccacctcccaggttcaagcgattttcctgcctcagcctcccaagtagctgggattacagacttgcgccaccatgcctggctaatttttgtattttcagtagagacagatggggtttcaccatgttggccaggctggtctcgaactcgtgacctaaagtgatccacctgcctcggctgcccaaagttctgggattacaggaatgagccactgcgcccagtcgacaattttatatcctgatttgcttgtgcataggtattttcccatgtaattctcaccctttcatgtgttattttttagcgactacataattattattctgatgacaccagatttcctgttataagtaatgttctaccgctcatcttcaggttcaaatctctatgcacatttcagattattttcttagcatatatttccacaaggggaattactgggtcaaaggatgaactatttatttatttatttatttatttatttattgagacgaagtctcgctctgtcacccaggctggagtgcagtggtgtgatctcagctcactgcaacctccacctcctagattcaagcgattctcctgcctcagcctcctgaatagctgggattacaggcgtgcgccaccatgcccagctaattttttttttttttttttgagatggagtttagctcttgatgcccatgctggagtgcaatggtgtgatctcagctcaccgcaacctatacctcccgggttcaagcggttctcctgcctcagcctcccaagtagctgggattacaggcatgcaccaccatgcctggctaattttgtatttttagtagagacggggtttctccatgttggtcaggctggtcttgaacttctgacctcaagtgatcggcctgccttgaactcccaaagtgctgggattacaggcatgagccaccgcacccggcctaatttttgtaattttagtagagacagagtttcaccatgttgcccaggctggtgtcgaactcctgaccttaggtgatccacctgccttggcctcccaaagtgctgggattacaggcatgagccaccgtgcccggccggatatgaaccttttttaagagttatggcgagaccctgtctccacaaaaaatttaaaaatcagctgggcatggtggcatgcacctagtcacagctacttgggaggctgaggagggaggatcacttgagcccagtaggttgaggctgcagtgagccatgatggcgccactgcactacagcctgagtggcagagtgaggccttcagtcatgatgccaaattgcttcccagacaggctgtaccatcatatgagtaagcttgcttcatggcctggtggttagtcaacacacgacaatgttttctttctttcttttttgaaaatatttgctaatttaggccaggtgtggtgactcacacctgtaatcccagcactttaagaggccgaggcaggtgcatcaccaggtcgggagttcacaaccagcctggccaacatggtgaaaccccatttctaccaaaaatacaaaaattaggtgggtgtggtggcgcacgcctgtgatcccagctactcaggagggtgaggcaagagaattgcttgaacccaggaggcagagcttgcagtgagccgagatcatgctactgcactccaacttgggcaacagagcaagactacatctcaaaaaaagaaaaaaaaagaaaaaatttgctaatagggaaaaaatggtatcatcagtgttttaattttctgcagattaaaatggacatttttgccaggagggagggtggctctgctttcacacaattcagagcacttactattttggaatgtgttcactgctgttttagtagaaaatcttgtccccagccctgctacccctccctacacatgagctccacgcattcagtctttctgtgaaattccaagctgggcagtctgtttctctgtgctgctccaagtgggtgtgcccttcttgggttttgtaccaattgggatttttaacccaagcaaatatgggtacatatttatgtccaatttgggggaaagaaaaaaaaaatgaacttactaagaagttgatgagtgagtttttgtgacaactgcctgtcgtcactgaagcctccaacaaggtgtacttccagcctggcaaagagatgagacgggtcagaggccagaagaagacaccggtgcgtgcgctggtctcactttgaactttcattctcagtttccatgaacacttgctctacagcagagctgcaggtcatcttcgtgccaccgcaaaagaaagtatcggcagcacactgccaaggccagtggcgagcttctggggaccctgcccaggggccctgatgactgaggggatccgtatctgaacacaaatgtgatgccgcctccatgcaccagtggggaactttgctctggaagagcacaggcacaggacaggtgcagtggctcacatctgtaatcctagcactttgggaggctgaggtgggcggatcacttgaggttaggagtcttgagaccagcctggccaacatggtaaaaccccatctctactaaaaatacaaaaattaggccgggcgcagtggctcacgcctgtaatcccagcactttgggaggctgaggcgggcagattgcttgagctcaggagtttgcaaccagcctgggcaacaaggtaaaactccatctctactaaaatacaaaaaaaaattagctggacattatggcatgtgcctgtagtcccagctacttgggaggctaaggcaggagaactgcttgaccctgggaggcagaggttgcagtgagtcaagatcgtgccactgcactccagcttgggctacagagtaagactctatctcaaaaaaaaaaaaaaaaagaaaagaaattagccgggcatggtggcacacctgtaatcccagctactcgggaagctgaggcaggagaattgcttgaacctgggaggcagaggttgcagtgagctgagatcgcgccactgcactccagctctgggcaatcgagcaagactccgtctcagggggaaaaaataaataagtaagttgggcgtggtggtgggcgtctgtaatcccggctactcgggaggctgaggcaggagaatcacttggacccaggaggcagaggttgcagtgagccaagattgcatcactgcatgccagcctgggtgacagagccagactctgtctcaaaaaaaaaaaaaaaaggtttgaggccaggtgtgctggcatatacctctattcccagctacgcgggaggcagaggtggaaggaatgcttcagcccagaagtttgagactagcctgggtgacagggtgaaaccccggctctaaaacaaaaacaaaacaaaacaaaaagactgggcaactgcctgctggaagccctccttaggagtcacactgcgcattgcacagtgaagctcttgagaagtcctgcgactgaaaaatccaactaactttcttgaacccagtgtttcccacactcatctactaacccccttttccacagcccgtcaagtgggcgaattcacgctcggcaaagtgttgccagactttacgctgccttctcagacacaaaatcttcctaagggatgaaccagaagcttggatgtacccaacatagggcacagcctcaaggggcctcataataaactccaagtagtagcagtaaggagagctgcgaccaccatggctttgccactgggccaccaggtttgcctctgactccctgagcgatcacagttctacaacagatcaggaagagctgacaagcacgttctgagaaccacggagcagagtgtgtggcaacataatggcattgattacgtccccctgcgggggccaagatgataggaaaatgaaaataccattttgggcctgcatgggtcacgtgtccatgaagccagcccagccttggcacagaccacagagggagaatttagaatcgaccagtattgactagcaaatctctcccagagaactctctctttcctttttagactcctaggattaagccttcgtatatgatgggagtagttcactcaatggctgccttagacttccagtaaaatgagagcaacacctgccaggtctccacaaagagcaaggagaggggacaggtgtgtgaacagtggtcttgacagcaggcctgtgtcgtcggcctccacctagctcctgtgtgctccagcacatcgagcctcagttgcccgtctctgtcaaatggaggcagcggctactttactgcagtgagagaggatgaggtgctgtgggggcacccaggctagaggccgcttcttatccagcaatccttggggaaactaccaatctgctggaatttaaaactatacccctcagctgggaggatcacttgagcccaagagtttaagaccggcctgggcaacttggcaaaaccctgtctctaccaaaaaaaaaaaaaaaaaaaaaaaaaaagctagctgggtatggtggtgtacacctgtggtcccagctacttgggaggctgaggtcggagaatcacctgagtccacaaagtcaaggctgcagtaagctgagatcacacaactgtgctccagacagggcgacacagcaagaccctatctcaacaacaaaaagagaacaagaaaaaaaactacatgcctcgccccctagcggtccccacatcttcctggcctcgttttctccacagccccgcctcaccacccaacaccccatcttgtgtacagtctctcggcttcggaatacaaacaccttgggccgggctttctgtctactcttcactgctgtgtccctagaaactacaaggtgtaggtgagaggaagcatttaacaagcaactgcgggaggaatgactgcatggagagctaccacacccgggggagagcaaaacgatgtgaaaatcgcaacctcgacgttcctgagacgacatcaagttcaaagtcaagccttccatctcaaatccagcacagactccttgcctgtgcccagcacccactcattcactcaaccactgctgacgcagtgcccacgtcgtgccaggttctgttccaggggaacgaggcagacacggcagtggtggcatcctgtgttcccctaacagcttccacagccacgtcctgtatgcgacggttccaagatctcaattcacctatgagagcagcgtagatctcaccttccacattgagcgtggtcagaaaaggattttatggagttcatgatcaaggggacctcagctttggtgtcggttccgtcacaatgtgtcaagcaggtggccccattacctgaagaacaagggtgaaaggactcaagttattccctgatgcgagtgcagtgcgcaggccgagactccgcctgtccctccggaccgcctcatctttgaatatcctgtaggggaaaaacggacaggtctgtgctccccagccaacccattctgaccaggacaccagggagacaccatgcagaccagaaaaaaggtaagcggagtccgcttccaacaagacaccaggaaactcaacacgagaaattcaatggtcccaaaggttgggtcagtttaagtaatggtttccttcacctctctcatcatacctgtgtgcctcaggaccacaatgtgacaagtagtggcatcatcagaacccagaatggagatggagcctgtttaaaaaagaaataaaataaaatatccaatagccttttgggataacgcccaattcactgcttcctaacctaccatcctttggggaggtcactgcaagctctctttgctgaacatacagaaggccctggggtcccacttgttgaacagactgacctctgagaagtctggctctttcctgtttaattaaaaaaaaaataaaatagtgatgtaaattagtgaggatggaaaaactaaagatgtggagagagccaaagtgggctctgcgtgggcagcacgctagtgtgtggggagtgtgttagtggacagagaggctcaaagaaaaaggcagcagccacggtcattcagaacaatgcagagaaaacgatgcggttctgcgcggtggtttttttaacctatgaaatcggatgtcatagtaacctatgaaatgagatgcaaaaatcctttattatagttttttgtttgtttgtttgttttttaaagacacagggcctcactatgttgcccaggctggtcttgaactcctgggctcaagcaatcttcctgccttggcctcccaaagtgctgggattacaggcatgacccaccacacccagctatcacagttctttactaaagagtgtgagactcttaacaattttaccattgtaaagagaatcagattacacaggaatagtggatggatggctctgaaatcacatcccctcttttttattttttgagacagtctctcactctgtcacccaagctggagtatagtggtacaatttcaactcactgcagcctccacctcccaggctcaagcgatcctaccaccttagcctcccaaatagctgggactacaggcttgcaccaccacacctggctgagttttatactttttgtagcgacggggtctccctatgctccccaggctggtctcaaactcctgggctcaagcaatccacccaccctggcctcctaaagtgctgggagtacaggcacacaccaccacacctggctgatttttatactttttgtagagatgaggcctccctatgctgcccaggctggtctcaaactcctgggctcaagcaatccacccaccctggcctcccaaagtgctgggagtacaggcacacaccgccacacctggctgagttttatactttttgtagcgacggggtctccctatgctccccaggctggtctcaaactcctgggctcaagcaatccacccaccctggcctcccaaagtgctgggagtacaggcacacaccgccacacctggctgatttttatactttttgtagagatggggcctccctatgctgcccaggctggtctcaaactcttggactcaagtgatccacccaccttggcctcctacagtgctgggattacatgcataagccaccatacctggcctccgcttttttaccttagtccctaacctagtaatttcacttctggaaatctgtcctaaggaaataactcaaaatatgttcatccctgtgttatttcttttatcttattttttttttttgagacagagtctcgctctgttgcccaggctggagtgcagtggcgtgatctcagttcactgcaatctccacctcccaggttcaagcgattctcgtgcctcagcctccccagtagctgggattacaggtgtgcgccaccatgcccagcttttcgtatttttagtagaaactgggtttcgccatgttggccacactggtatcaaactcctggcctcaagtgatccacctgccttggcctcccaaggtgctgggattatagcatgagccaccatgcccagccccctgtgtaatttgtaatggcaaaaagctgggagcagcaatggaaaaggtaagtaaattgggcacagaaccaagtcacagccactaactgcacagtcatgagaaatgaaaactatgggaaaaagagttttgaaatgctaattgaaaagcaagatacaaaagtataaaaaatgttttaaagagctataaatgtgccataatacaacaatgattaaatgcttatacccatagagaaaaatactggaaggaaatttcaccagtacaaccatggctgtgccaaaaaagcaaacatgagtgatttcctgttgctgttgtcctctcttctctcaatgttctatcacatagttattgttagaatacaaaaacaaaatggataaggcaaatttacgaaaggtatgttaatactaagtgtcaataatctgagtgtttgtacacacttatttagtaagcttgtaaaaaaaattcagtggttaaaaattcagtggttatttaacaaaaactttttcaaaatattaaattgatacaacactacaatgtatcataatttccttcttacttgcaacaaactcctggatgaacaaaatcttcctcaaatgtctagacaacgtatgtatgtattgcctacacaggaagacagttttgcagtcttagtcttctatcagcttcttgccatttcgcatgactggtgctaatttaggttagcgctcacttaataaaacataagagcagctgggtgtgatggctcccaactgtaattccagcactttgggaggctgaggagggaggactgcttgagcctaagagttcaaaaccagcctgggcaacaaggaagatcctgtctctacaaaaattacaaaaattagctgggtgtggtggcatgtgcctgtagtcccagctactctggaggctcaggtaggaggatcacttgcagccaggaggtggaggctgcagcgagccatgattgcaccactgcactccagcctgggtgacagaccaagaccctgcctcaaaaaaaaaaaaattaagattaaactaaaagaagagatgtaataaacataatgatcagcttgattacttacatggtgttttcttctgtttataaacttccattaactggaagcaaggtatcaatgaaaatgagacaagccccttaatttaagaaacaaactaaagattaaatgaactgcagtgtaaaattagatgggcaagacagccttgcttgctccagaagtcagtgagaaacaggtgtgactgctctaaaactcagaacacctgtacaggtgacagcctctcattttctcattccacttcttgcctcatcttagttcagaataacaggggagaattcagaattccctcttgattactcctgagatacttaccttctgctttgttctttgagggaagggaagagaagggagggcgcaaaggcgaatttttaacactcatgttcacaattgggtcaccactcaaaagcaaagctatttgtgagaaattaattactgctttcacaaagaccaaaaatcatgtctctcttcaacacagctcctacgatttcccaaagaaataaaagcaaaaattatcagaagagagaatgccagaaaactaaaacagtagactgctttgctctattttttaatttctttttttaaacagggtcttactgtctcccaggctggagtgcagcggcgagatcgtggctcactgcagcctctggcctcaagcaatcctcccacctcagcctcccaaggagctgggaactacaggcatgagccgacacacctggctagtttttgtactgtttgtagagatggggtctccctgtgttgcccaggctggtctcgaactcctggcctcaggtgatcctcctgcttcagcctcctttgcagtagctggaaccacaggcgcacgccaccacacttgtgctaggattataggcatgagccactgtgcccagcctctactttatttttaatttttttttttttttttttagagacaaggcctcactctgttgcccaggctgaagtgctgtggccagatcatagctcactgcaacctcaaactcctgggctcaagcaatcctcccacctcagcctcctttgcagtagctggaaccacaggcgcacgccaccacacttggctaatttttgctcttttaagtagtaaaaagagtttagccaaacttcccttctttggaaaaccacacagtcctactttataaattcatatgcaagtagtcccagttttcttaacctctaatatgctctagacactaatatttgcttaaaaaaaaaaaagcttttccctcagtccctcatccctatttcccagttcctattcaatggcagtattctcttaacccagtgaccagcagattttctgaaaaaggccagacagtaaatatttggggttctacaaggccgcagtctctgtcacaattgctcaactctgctgttattatgaagtgaaagcagccatagacaatacagatgtggctgtgttccaataaaactttatttataggtgacaccgaagttttaatttcaataccatttcccatgttacaaaatattattttgatttttctcaacctttgagaaatataaagaccattcttggcctataggctatacataagcagggtccggcccatgagctgtggcttgttgacctgtgtcttagccaatcacctagctgtgacctgggggatgatcatgtgaccctcacccctgctgtcctgtttatcaattcttcctttataaacaggagaggggcatgaaggtgatctgtgaactgtaaagcacaatgctatataagaaattatgaggcccaacacactggctcacgcctgtaatcccagcactttggaggccgaggcgagatgatcgcttgaggtcaggagtttcagaccagcctggccaacatgttgaagccccatctctactaaaaatacaaaaattagccgggcatggtggcagatgtctgatactcaggaggctgtggcaggagaatcacttgaacctgggaggcagaggttgtagtgagccaagatcgtgccattgcactccagcctgggtgacagagcaaggctctgtctctcaaaaaaaaaataaataaataaataataaaagcaggaactaagctacgctgcgagcatcttgtagactctgtggaaccgtattacccaagatgttgcaggactggttaccgagtacccagtgactggttaagagtgactaagggagggctctaaacagctctggccaaaggaacttcatgctgggatggccaccgtctatattcacactgtctcattagtagccatgctgtctgctcggcacttgaaatgtggctactgcaactgaggaactgagtttcaattttatctaattttaattgatttttaagttaaatcctaagtaaccagatggctcgtggctactgtactgaatagcgcagctccagagtcaagggcaggctgccagggttccaatcctggcttcaccactcccaggatgtggggcctggggccagtttcccagcctctctgtgccccacagtcctcatctgtaaaatgggaatagcagtaactcttgctgtggtgcttggcagcttccactgtatgacttattgttattatttgctagtcatagctacacacaggcttctaactgttggtactccatactcagaacacatcgttacatgaaaaagacacattataaaacaacatatagtaagctatcatttttttaaaaaaagtaaattatatacaaagaaaaaccttcattaggactttcaccaaactaaagaatggttgtagtcatacttttttttctgtattattatattttgctttcctacaaagaggacaccctgttttattatataaaaataatccaggccaggtggagtggctcacaccggtaatcccagcactttgggaggccgagacgggcagatcacttgaggtcaggagttcaagaacagcctggccaacatggtgaaaacccgtctctactaaaaataaaaaaattagctgggtgtggtggcatgcacctgtaatcccagctacttgggaggctgaggcaggagaatcgcttgaaccttgggagacagaggttgcagtgagccgagattgtgccacagcaatccagcctgggccacagaacaaaactaagtctcaaaaaaaccaaccaaccaaacaaacaaacaaaaaacccaacctttaatgtctccctgttgctaagtaggtgaaaggtccatctaagccccttggtcatttggtcatctgggtacaatccacccctgtaaggttactttccatgcttcccctcctcacccgggctgctccggagaaactggccaggacacccacccactgggcccttcccctcctgcccgccgcgccccaggcggcttgcccagctgcgatgccctcacccttcttctccttttcaaatctctctcgtgcctgcatccttcttcacttacactgccgcaaatcaaagtgatcgcccccttccaaagttcctgtaacacaaactggtccccagtacacagcctttctaggacatgtcttcttaaataggccaaaaccttccttcgagagaagcagccccggtatgtcaccaaatctccctccacacttaagtgtgcagcccgggacacccatctaactttctatcacggacattttcaaacagacataaaagtagagcatcccctaaattcttcaggcggctgaaattatttttccttggtgagtcctactcttgacttcgctagctaacaggacagtaacacaacgcaaggataaagtgacacgccaccacgcctagctcggtgcatgttggctaacagacgatggtcggtcctgaaatgcaagctgagaatcacacagagctgtctgccttctccccgtcagtaagtccttgtcacccttcagaacacgttcaggggtcattttgtgacctcatttatgcagcaaatctttactgagcgccaattctatgccagggaccgtcctacactctgaggatacaaaagtgaggacactactcttatctgccttcaggaggcttacattctggcgacagaccaatagagaacaaacaagcaaacaaaataatcacaaactgtacagctgtgacagatgaaacctctaaatgccttccccaacccaacacacttggtcaggttcctgtgcttcccatctcagagtgaaaggggacgctttttctttatggtacttaacagtttatagtatctgagccttcttcatcagaaaccattctcccttctagactataaacactccgagggcagggacagtgatcagtacgttgcccaacagatattaggggctcgatatttgactctcaaatcaaggaactgattgattcccctttaacaggatctatggcaaataggacgtctgcccccgccgccacgccccgctctttttaaaacctgagaacccccttgccaacagtccctgcataagcgtggacaagagttcagagatctatttgagcacaaaagcagaaaaaacaaaaacaaaacccgtgcatcagggcgtggtcctatggcccagctgcggaaagcagggctctctctcccggctaaaaataactcggcgccctacgccccgggggtaggggagagagaggaggaaggactgggggtccccgccaagatcccccaggccaaacgctctccgaagcccaccctggaataacctcctgcttcacggggacgcaaggacgaagcaacgttcaccgcaggctgcgggtccccgaaggcgggcggccggatttgcctaaacggacccagccctatgggggctgcagccgccccgtcggggaatgggggtcccggcgtgtccccgagccgcagtgctgtgcgaccttgggcaagtcacctaacctctctgggcccccgtcccctcccttgtcagagagtggcctccggggcagcccgctgaagtctaaagaaggcaaaaactccccgacccctcaaggggaagacgcgagccgacggccggggctccggatgtgccaacagcgccaagtttcaagtctgtgtcgcgtgaggggggcgctagcccgccctgcagcttcccctcgggcccgccccgaagccccgcgccgcgccccactcacctccaaaggcgggtgggctcggacgaggtccccggctgactgcggcagccgcactcgccgcccctcgacgagcagcggcatcgcggaggcggccgcccaggcaggcccagggaggcggcggccccccgctttgcagccccgggccgcccgccgcccccgcccctcgggccgcgcgtcccgcctcgtcctgccccgccccaccgcgggcgctgccgggaagtggagtccaggcggaggcggtgccggccgaagagactggagaaatccaggacatggccgcaaggcctcacgggaaatgtagtccaaagccaggaagtggccctggaagcagcgcgcggcccgcctcctccgcaaggggcgctgggaagtgtagtcccaaaagcgtgggagtgaaggagcggggaaaggagagctgccagggagcagctgcaccagccaagagagcctccgggcgagttcctggggcgggttctggctccgactgctgcgctttaggtcattgctccacgcttcccaggtgtgtgaccttccacaagcttgagtttgggaccctgctgtgcagctccgtaggattgcattcaatgagtaataataaacctaatcaggcgggcacggtggctcacgcctgtaatcccagcactttggggggccgaggcaggaggatcgcttgaggccaggagttcgagaccagcctgggcaacatagtgagacccaccctcccccataccctcgtctctgccaaaaatttaaaaattaactgggcacggtggcatgcacctgtgatcccagccactctgtaggctgaggcgggaggatctcttgaccccaggagtgggaggctgcaatgagctatgtttgggcactgcagagggacactctgtttctgaaaataataaaaataaatgtaaacggtcttaaactgagaaaatagatcctgaactgtgctagccccacgtactaaagagatcatcgattaacacgtcgtgattggaatgcaataggccactcacaggtgggctgggaaccgtgggggaaggatttgcggatactgactgcagagcccctaatctgaggacaggtccccaaggtgagaggcgtctcaccgtggagctctcttctaaaacttggaaatattgctcaaattcatccaactctgcagcacattaacaaaaagtaattttacaaaagatacagaggagccacatgatacagcagaaactttattagaattttatcatctgtattcatcgtcttctttcataaatctccccctcagcttacacaccccgttcaacaaaaataccaggaaatttactaaagaaatgactgtagaagatggtgttcccatcgccaggttacccaacttctcacccaaaataactctatttctagctaccaggaaattatttctctgtattattacacctacatttctcatttgtccttacaaatgtaggagctactatcaacacctcatttgtcatttgtcctcacaaatgtaggagctactatcaacacctccgttataacagatacagtaacttgctcaaagtggtagaaataagtagtagaacgaagactgaacctagctttgcatgattccaaaggcagtgctctccatcactataagatgctcctagactgtactgtaaacaactcattctaatgcaggtgacattaagtaagtcccaactaggaagctcggagctaaaaacagggtttgaaaccagggtgatcaatgaccagcaggctggcctggagcaagttacttaacttccctgaactggttttgtagaatagcatgtttgtttcacctggtacatactaaacactaaagatagctattattggaattgcagagcaaagagtagtcaatcaaagtgaggcatttggaagtgcaaaggtgaagaacaaggttctgtgggttctgcctggggctggtgcagtttgcctaactggtttttcacttttgggtgatcttttttcaagtaatctcaggttatcaatctcctaggctgagtactgtgttaaaggactaaatgagccagataacaagcaggaaaccactcccctacctctcttcccacccagctccacaaattttggtctacaggcaatgaggaagcaatagcaggtgtgtggccagcactgcggctcatgcctgtaaccccagcactttgaaaggccgaaggaggactcacttgagcccagaagttcgagacgagcctggacaacacagggatccctgcttctccaacaaatacaaaaattagctgggcatggtggcaggcctgtagtcccagctactcgggaggatcaatcaagccctagaggtcaaggctgcaatgaggcacgactgtgccactgcactcctgcctgggtgattacagcaagaccgtctcaaaaaaaaaagaaaaagaaaaagaaagcactaattacaatgttggaaagcctgtttctttaagataggaaaccaacctgcctcacaagatggctgatggcaaagttcaaagaatatatacagggaaatattttttaaattacacttttttgaggccagacatggtggctcacgcctgtaatcccagcactttgggaggccgaggcggacagattgcttgaggttaggagttcaagaccagcctggccaacatagtgaaactccatctctactaaaaatacaaaaattagccaggcatggtggtgcgtacctgtagtcccagctactcaggagactgaggtgggcggatcacttgagcccaggaggcggaggttgcagttgttgagctgtgattgcaccactgcactccagcctgggtgacagagtgagactcttgtctcaaaaaaaagaatgatgaacattatacagaaccttagtaaatatttagtgaaaggatcccaatttgtgtttcaaattttttaatgtagagatgggggtctcactatgttgccccagctgatctcaaactcctggcttcaagagatccttttgctggcctccccaagtgctcagattacaggcatgagctaccacacctggccccaaattattagatacattataaatcctactcaaccatccagagtcagactgaaacacacaaaagcatttgatggaagaaaacatggtggagctttggatgttcaattagttgaaacaagaaaagtatgcagttgtacaccaatgaacagttctcaaggcagcctgcaccttcgaatcaccagggggctttaaaaaccatccatgtccagacccctcttctggagactgattcaatcaaaggttgagttggtgtgtgacgtgagcctgggcatccttagtttctcagcactccaagggactgattctagggcacagccagggttaagaaccaccatcgtaagcactgcccggcaagggaaacacgctggttcctcctctccagttcagatctaagttggtaccagggaggtaggtattatggaagaaatagaagttatctttaaccaaaaaaaacttcccatggaagtgcttcctttcttgcaagaaaacaacagccattaacttgtacatgcatcgaatccttaaagccttacactagtatcttattcccattttacagtttaattagcgctcagagaggttaggtaacttgctcaacgtcaaacagctagctaggaaaggaagcccatggcacttggtaagttgacttgtaaaaattcagccacttctcatcaaggaagaccaaaccagagcacacagacaaaaggacagaccctggagactcctacaactgacagctttttagtgaaaggaaaaattcccattgttggcatgtaatttataaggagatttcacagtatttttccccatagatgtcccttcaaagcatgtaactttttgaaagaagtgtctgcttcccttggacctgctcaagcctcaatcactctttgctgggtgtgattaaggagagtcgcggatacttcatatagtgcacacggaaaccatcctcaccccggcatgcaatgaattccatcaagctccccgccacaccagcactatttctccctcttcaacagcaatgcctcaggagttttccactgcaaaatgctttaatacattaaattaaaaaaaaaaaaacaaaacagaaattgaaagaacatgtattgaggtaccttttattggtataagaacgtaagttccagattaaccatgtcattgtttcattttcaccatggattttttttcacaaactcctttgaaattaaacagacttatatgtaaatgtctttctacattaaaactacttcccaacccacaaagaccccacttactactaatttctggggaatttcgtttactcgttttatctaatattaaaaaatcaacattttgccagcagttaaaaagacaaccttaaagttctcaaattactttccaccaaacccggaaaagaaaaccacccatatccaaaactttaaagcaataaaaatttctattttccaaaaaagtatttacagactgaaattcaaactctacattgccatcaatgtaattatacaagtgcatacaaagccctggaaaagaggaagtatttcattacaaaatatttatgatcaagaaaatattgcttgcctttaaataaagtggcagaaaataaatatgcttaaagatggccattttcacaagtaaacaaaaaagtacacatgtaagaaacaaagtgaaaatgcttgagcttcaaaatgactctagcagtgtttgcacaaatttgttttaaagcgaggtcttctgaagacttcctctgtttagttataaaaatacaaaaagaggctttagagaaggatttcaccaagccgaatgtgcgatgcacacagccatcagaccaagactgcactagcaacttccacctattgttgtgagcaaaaccgtacaccaaataatctaaaaaaattttcctgtttccaacaaagaaattcccaataactaagtgatgcagatcaaaactgactcgatctaatggccaccaaggagcagttctagatctaaggggacacttgagagccaaggggtcaaatccaatctcatgtgttttacacaagcccgaactcactttcagtctgtgtgaattacatctacctggacctccatttttgtcttttaaatccattttttcgctgtgccaagtatattacacatctgattctgtttccctatatcctctctctcttccctatgggcttttattggtctctgaagtccctggagatcttcagtgccagctccaactctgtgtcccagaccatgtcgggccagctctcagctttccttctgtcttctctacactcccttgaaatcccaacagacaaataccaatacagcagaaggtgaacaatgtagccaaaataaacactttctagttaaagtctttaaatagaagttttatcttagaggattcttcactgaaagctcatcagtcaagtcctaagaccatggatctgacaaaaacccatgttaaaacagcaacccgtaaaacagtctgctgcctatattagaaattacccagtaattgtgtcaaaaagctgttaacacaaaaaatgtacatattaaacaagcaaatccttccaaatgtatcatcaaccccactgtaaaagattgcacatgatagtcttcattttgtctgtaaggggaacaacaacaacaaaaaaacccagtcttcagatgcttgattcagtcgaacctggaagtgccacagccgaggcaggcactcgctctagttcaatgccatcaatgcccaatggcacaagctgggtgctgagggcatgacaagtgatggggaatcccaaatgtcacatctcagtcacaaatttctgccgtcagaggggactgggttgcatgtacaacacgggtggggagcccacactacttgaaggacttcggaaatgcgtgtcaaaggagcttggtgtgatcccaatcacggtatcattctggggcacttcgcctttcagaaagtcatcatcttcatcttccactatgtcctgcagaaacatcagaaatcatcagtaacatcaccagtgctgactgaaaagctttcaacaattccttcctcaggaaggtgttaacgtttgtaaagatggtgaagaaaatatcttaatttcaaaagaaagccagtgtagtggcacacgcctgtagtcccagctactcaggaggtggaggtgggaggactgcttgagctcaagagttccgaatccagcctgggcaacatagcgagaccatgtctctagaaaaacagaacagaacaaaagctccctctgataagcacttccttcttaccaacatacccacataactgctcatcacacattgtaatcatttgtttcaagtctgacttgcaaacagatttgaagctcaatggggacaggaaacatgacgagtcattcttgcccagtgttaggaactcttgtacctaacacaatgtgaatgaattacacgcccctcaacaaatgaaacataaagaaaaagatgaaaggggctttccaatgattacttattaaaaacaacaacaaaaaagccatcttgaagctgcttttaatgagaaaacaaatgtgctcccaagcaacagagcagcgaaattctttattactggattctaactttcctctctaactgtaactgtctcagctccacctcatgtgacctggagggtatgttgcaacctgcgtcttcaccacccattcatgaagatctataaaactaatgtaaactgctggggcaatttcaacatgagtcaactggagattgttacttggtaagaatgcgcaagtggcaaagatctaaattcattcagctaatttgtaattaaccttcgcttctcacatgtcagtatgtgaagtgtctggtttaagcaatttatccaaaaaagccatagactctttaaataacaacaaaacctgggcctggaattttataaaggcagaatgagtaagacacggttttggtgtgcttttttaaagaaaacagggtcttgctctgttgcccaggatgaagtgccatgctgcatttacagctcactgcagccttgacctcccacctcagcttccagaggagctgggattacaggtgtgcaccaccacgcccagctaattaaaaaaatttttgtagaaacagggtgtcactgtgttgcccaggctggtctccagcaatcctctggccttgaccccctaaagtgcggggattacacgcacgaacgacttgccacttactatctcactgtgacctggaaccagaaaggagattccgagagtgtgctcaatcaatcacaaactgacctttttcatgggtttcttgaactcctgtagctcttcagcactcatgtcttcccacacctgataaataggatcaatgaatttctttgacctgtcaacaaagatcacatttcaaagtcaagttaaatacttcggcagaagtcaaaattggtttggatcttttctcacaagatctattacccaaaaccaagaagtgaaaactacagcttaaataattacatttaaaaaaaacctggctgggtgcagtggctcacgcctgtaatcccagcactttgggaggctgaggtgggcagatcatgaggtcaggagatcgagaccatcctggctaacacggtgaaaccccatctctactaaaaatacaaaaaattagccgggtgtggtggcggacacctgtagtcccagctactcgggaggctgaggcagaatggcctgaacctgggagacggagcttgcagcgagccgagatcgcgccactgcactccagcctgggagacagagcaagactctgtctcaaaaaaaaaaaaaaaaaagaaaaaaacaaaacaaaaaaacaaccctctatgtaaatgctgtaactaatgtggctctttctgtataagagttcattcactcatgtcgatggagtattgaactaccgtttttcatctttccattttcatgtgaaattgtttctaaactttacaaagactcacaagtcagttagatacagtatatccaaatggaaatgaaaccgtaatattctggaactctcttttttatatttctgtagtaatttgctgaaaagtaagtctaggaaaaacaactaatctggtttcagtcaaccaagacttcagggaccagacaatcccagatggtcatgatgctgctagttattttagaaaccataataagcaaaaatcctgcttccttatacaagtgccaagttaaggctggcccagtggttttctagaacaactcatctagataaatcgctttttgttttttttttgttttgtttttctgagacagagtctcactctctcgcccaggctggagtgcattggtgcaatctcggctcactgcaacctccacctcccgggttcaagagattctcctgcctcagcctcccgagtagctggaattacaggcgccaccaccacacccagctaatttttgtatttttagtaaagacagcgtttcaccatcttggctaggctggtcttgaactcctgacttcaagtgatccgcccgcctcagcctcccaaagtgctgggattacaggcatgagccattacgcccagccaatcgtttgtttttcgtttatcctgtgcaacagaatggtatgtggtctctagaggaaggaacaagacacttggcagaaaattatgaagcaagaaaagacagcaccctcccctatcctggcaccattatccccattaaccttacatgtttaaataacagtttaaagaaaaacaaaaaacaaaaaacccttgatgtcagtctggctcctagtgaggcaaagatctacccactctggggtgcctgcgccactcggcaagtcctgctaggcatcctctactttgcatctggtgaaatatacgcagggagaccacgagatgctcatcaacagcgaggaagggccacttctggtgaagagccctaaatcccaattttgggaaaagcaaacatgtatcacgtttaaatccacctcctggccgggcgcggtggctcacgcctgtaatcccagcactttgggaggccgaggcgggcggatcacgaggtcaggagatcgagaacatcccggctaacacagtcaaaccccgtctctactaaaaatacaaaaaattagccaggcgtggcagtgggtgcctgtagtcccagctactcgggaggctgagtcaggagaatggtgtgaacccgggaggcggagcttgcggtaagccgagatcacaccaccgcactccagcctgggcgacagagtgagactccgtctcaaaaaaaaaaaaaaaatccacctcctccagcgtcaatgtttaaaagtacctacctcttcagcacacagggatcaaaggggaagaaggtgtccagcgggtttgtgcagatctgcactgagtctcctccagcggtactcctaatgactggcagcatctggcgattgttcctctcaatgatggtgtagcagaagacgagctggtacttactgtggaacaaaaaaacaacacagacagaggcattaacatgctggagtgactcggtgcagatgtgagctgcgtgtgacaactgtacctaccacagagaaattgctgaatataacaagtgctagtaaaaataacaatataaagcagaaagtaacacttttagggtaccgttctatgggtcttctatttgcaagtttgctaaggagaaagaaaacgtggctatcactcagaatgtgaaactgggcttatattttaatgagtaatagatattattcattatattttaatgagtaatagatactattcattaaaaataaatgtttgcaaggcaaaactcttagattacgtaactataggtgtctttatttttactgtttgcaaaagaattagaaggttggtggtaaagggattcaggagttactcaggaggaaatagtggttggtgaagagacttgctgaagaagcactgaaaaagaaataagcctttactgaaggagggacacggggttgactaagtcatgacctcaaaaacaggcacagaaaggactaggcatgccgagtgagaacagttaaatgcatagaagaaaacataaaataaagacaattatgtttttaatttttccagtagttgtctctaaatgattgagcaacttgaaaaattatctattggacagcttctccaagatgaggactcagatctcacttctgtcactctccatctcaggttctcaggtcaccatggcaacttcaagccacatactttgatttctgtcctgttagccaaggctcacagcacttgacccctcctcctggtggaggacacatcagcaaaaccacactggagggtggtttgcactatcaggtaaagttgaagatctgcatctcctacaaccccgcagctgaccgcacttccgggtgtgtgacaaggaagcatgtgcccacacacaagaatgttcctgagcactaaaacactaacacagccggctgggcacggtggctcacacctgtaatcccagcactttgggaggttgaggcaggcggttcacttgagctcaggagtttgagaccagcctggtcaacatgatgaaaccccatctctactaaaaatacaaaaattagctgggcgtggtggcaggcgcctgtagtcccagctattcgggaggctgaggcaggagaactgcatgagcctcggaggtggtggttgtagtgagctaagatcacgccactgtactccagcctgggtgacagagcaagaccttgtctcaaataaaaaaaaaaaaaaagacaaaaactaacagatgaaatcccaacaaagactcaataaaaaagattcccagaacataacacagcagttaaaatcaaaataaagctttgtgtcaatatggttcaatctcaaaagcatcaagcaggcaaaagcaacagctacagaatggtacacgcctttatttaccatatctgtacctaggcagagacttttatttcaatcccctgctcttagcctcacatcgcatcacactctgtgcctccaatgcgcatgccaaccccaaatcgagagcccctggaccagatggttcacaaatgcagtcctctgtccccaccccgagaacataccaggggcagcggcctctgctttgcttcatccatcctcactctttgagctgctcaccatcttaaccaacgtgctgaagcctccacccactcactgccgttgcttattggtctctttatgccttttcctaatcctttactatcactgagactcagaagagaggacaccttgaaccagacgcctagcaaaggagaactaaagaggctgacggagctcagcaagctgttggctcttatctgttgaagattttaagctatgatccggcctaaatatcctcattgaatattcaattctccaattcgctttctccataaagcagaataacttagtgaaagcttacaaaggagccagactacatttaaatctgtgctgccagtctagctctatgactttaggcaagtgatttcacctctctgtacctccacctccctgttgataaacagggtttcatcctagaggatcaaatgagttctatgtaaagtgcttagaactgcctggcacagaggaaaggctatggattagccatagctaccagacctgagagaacagaactctctaaaccaatctcttacaggtcaacatttgcctcatgtccagtttatttctattactattacaggagtcactctaataagcatctatggctttgcccctctcagcttactggttgccatacttatttcaaagtgctgccctttggataagaagtagtagtaatttccaacgccatcaaagtataaaaacaatagctgtatcacagtatttcctgcaaggactgggttgtttttgtttgtttaagagacagggtctcattctggagcccagactggagtgcagtggtacaatcagggctcactgcatccttgacttcctgggctcaagtgatcctcctacctcagcctcctgagtagttgggactacaggcacaggcaaccacacccagctaatttttaaaatttttttgtagagatagggtctcactatgttgctcaggctggtcttttaactcctggcctcaagcaatcctcccacctcagcctcccaaaatgttgagattacaggtgtcagccaccacgcctggccttttataatgttactaatttcatagaaatttaacactcttacaatactagataaacataaataaaaatattttaaataactcccatcaagaaagcgtaaataacttactttgtgattgcagcaaaaaagttaaccactgagggcaggcaaatcttcaggggatttagctggctcatcactatccgctcaaaattcagactctgaagatactgcaaacctttggtttaaaaaaaaaaaagatttttttaaaggtacaaataagtgaaaagtgtaagatacttttaaaagcacaaattatcacacatttaaaaaaaactttaaaaaattatttgcagaaatgctttaaataaaggtccatgcagatagtcacacagtatatggcccagaagagtatcactaggctaaccacattcattggtcaccaaggcagcttctctaaagaaaacttaggaagtagcaggctgtaagattccacgacaatgtgaaattcatatgtttgcaagctcagtgtatgctgagataatacagagggagaaaagaccttgtgatttggtttcagctaacaatcatgacaggcaacaaaacaaaacagcaatttgattctagcttgcatgtcttgttagtgaagctgagtgctgttttcaggtgcacagtagtcatctgtagttttttttctaaacaagaaaactccaaatttgccttctacctcaacggacggcaaatttagacagaaaccactttcttagacttaatgaatataattcttttctacatgagtaaaataaagacatcacatttattttaagaggcaagctgaccaacttgtacttaagtatattttcttaggagtttctttgatacgtatttcaataaaaattacctaaatgggatgtcacagcttacaaaaacaagatatttaatccagattcctggcattaatttatacaaagaaaagcagagcttgtatttacttaccttgtgataaaacctcatcctactagttcatacaacatcttttagaagcatgtaggatgtaggtaaacatatataatgcaacacatacaactttcagtttagagctgtggctgttaacccaaggagactgcgacccccgcagaggacacctggcagtatctggagacacttttagttgtcacagctgggggtggtcggggactgctgttggcagctagtaggtggaggctgttaaacatcctacagtgcagaggacagcccccgacgatgaaggatgatgcagcccaaatggcaatcgtgcagggttcagagaccccggtttagaggaagtgacccacaaaaccataagaattattcataaacataaacagaacaatttacaatgacttataaacactgttcttggagactctcttcaactaaaatacactaatctaataagtttcaactgacagatttgaattataagtaactcttagaaattagcaaaacaatactggtcaattaagtctcaaggcttcaggcagagtttaatctatataaactcaaactttagggtcagccaaacctggcttcagttttctaatcctgccactaaccatgtgatcttgggaaaatgactttcctgtgctttagtgctgtctgtaaagggagaatacctgccatttactgggctgttacaaggacaacaaagagaaggtgcatccaactgaagctttgtacagggcgctggcacagcccagggctcagcctcacctctggagacatcttcacatttcaaactttcaaaggcagaaacctctttcttaacctcaaatccatcttaaggggtttgtagggttctcaagctcaaatctatcttaaggggtttgtaggggcctatgagctgcttgaaattattattaaaagtttgagtgcacatgcagttttctgaatccagtttttataaaaatctcaaaaaagtaatgaatcaccattctgaagggtgacaagaacacaaggaaaatccagtccagcactcccacaacactgaccttctttcaggtttccgctcaaaagctgcttgtgtctaaaaacaaaggtgtagaacacagcttggcaggctgagtaaaatggtccatggagagcaacatcgcagaatgcctttgttcccgaatcctggttattaaggtatatgtgcagccagttaaccaaaagatctaggcatgattttacagtactagagaaaagaaaaattcaagtcaactttacacatcataaaaaaaccagaataacataaaaacacacaactgcctttcattacaaaccatgctaagtaagttcataggtttctttaaataatacccatgggtacagaggaaaagcaaagaaaggaaggataaggatgggtgcgtaggaagacaaccttccaattacaaggcagagtagctctgaccttctaggaacaggtgagcccctaagaacgtcccaagggatggaaagcaggttctcctaaccatctcaaaggcacccctcttaaggtgattggccaaacaggacacgttcaccaacacctctcaagagaaagacagtctggtggacttcagtattccctgatgcatcctagtcaagtcctatggtgaataattttgtggttggggaagggtttcaacagcatccttgtccaaaggtatctttatgggccactggaagaaactggcctcctagataggtctattacctttaaaagggtttttcttcagctttaacagatacaatagatttggaatgcaaatgaaaaaatgacaaacctacaaaaagaatcaaaacagtatacaacactgtcctctatccacaaaacaaatggatctttaagtgcaaccaaaagagatgacaaaagccttacatacagggttttatatataaaaaaggagacactttattctaaaatcaccacttagaaatataaacatcttgcacagagtagggattttattcactttaaaaacatgccaaaaaaaatgggagatatttctgacttgagacaatgctatactctttttaaagcatgatattaaaaagtattcggaaaattaggctacttacataagaggaataaatttagctcttgccaaaaagcttccaatataatttccagcagcctgcctgatgatggcaggattacttgggtcctgcaattttttccagagatgttccaaaaatgcctctgcgaatccctataaaaagagagggcgtcggtgtgatcttttttaatgcctaagataatctggctatcaaaatcccaagatttttacttcaccaatgtagggaaaagttctactatctcataactatctcatgggcttcatttttaaaacacattgagagaatatcattaaaaacaaaaggcacctcgggtgttaaataatccagtggatcccaaacctagctaagcatcacaatcaacccggggccaggcacagtggctcacgcctgtaatcccagcactttgggaggccgaggcgggtggatcacccaaggtcaggagctcgagaccagcctggccaacatggagaaaccctgtctctactaaaaatacaaaaattagccaggcatggtggcaggtgcctgtaatcccagctacttgggaggctgaggcaggagaatcgcttgaacccaggaggcagaggttgcagtgagctgagatcatgccactacactccagcctgggtgacagagtgagactccatctcaaaaaacaaacaaacaaaaaacaacaaaaaattcaacctgggaggtacaaattcaataggtttgtgacagggctttggaatccacatattacaaaaactcttcaagtgattccaatgtcagccagaactggtgaccaacaataattcacatcccatggagctccacatgggcactcctgtgagtgcaaagcaccttccggtctctggacacactgaactcaaccacgaacagaaatacggactaacgcacagctggtatttgagttaattatgccaatcatggaaaaaaacagacacagcttctcaccaaagggtgtaacttccaacttctcctaaatagcgctgttctaaagctaggcacacccatgtgggcagactgaattcaaccttctttcccatgaccaacactctcctgatctctaggaagccacaaaatcgttgcagagaaggaaaagccttctacattctttcccccaccaaaaaaaaaaaaaaaagaagaagaagaagaaaagacaaagcctaaagtttttaaaattctagattaataagttggtttgggctagttacaactcaacccttggaaagaataaaggaaatacagttaattaccccatatgagattttaatagagaaaggcttaagggaagagcaccacctagtgaccaaaaggcaggatgacattttcggagcacctagctgggctggcaggcagcaatctgttttctctccaagtgtactgagaagggaacgtgggccaggcacagttgttcacacctgtaatcccaacgctttgcggggcaggaggcgggcagatcacttgtggtcaggagttcaagaccagtatggccaacgtggcgaaaccccacctcttctaaaaatacaaaaattagccaggcatggtaacctgtggtcccagctatcgagagggtaaggactgagagtccgttgagcccaagaggtggaggttgcagcagtgggcagcagagcgagactgtgtctcaaaaaagaaaggaaaagaaaacaaaaaaagaaaggagaatgcgattttattaagcagactagcaagtaagctcaaagaaaagaattatttacttcatggtctccgtccaccccagtttttagggaaaatttttgggcaaaaacaaagtaagctaagataatgttaatcacattcttactcaccaatttgaaactacagaggtaaaacatgaaaaactgtacatggcaggaggcatgggtgggcaacaggagtttgtcaaagatgtttatcaggtcgcgatatagatcctttgttttgccgttatcaaccttacctatggagaaaatctggcatctcagtttttataaagacatattttcaagtttcatctgccatattttttataaacacaacaccattaaaaaacaacattatccagccaagcacagtggctcctgcctgcaatcccagcactttgggaggccaaagtgagagggagcccgggagttcaagggcagcctggggaacacagggaagctctgtctctacaaaaaatcaaaaaattagccaggcatggtggcacgcctgtgatcccagctacatgggaggctgaggcggatgaaccgcttgagcccaggaggtcaaggctgcagtaagccatgtttgtgcgactgcattccagcctgggttagagtaagaccgtggctatttaaaaaaaaaagaaagacagacattatccattaaaataccattaaaacaaaatgctacttttagtttacacagattttcctctgaatataataatctaacacctgcaaggaagcaggccctcacctcacacactgtggcaaggtcagaaatgcaaacccttctgaagagcaattctatcattcgtgtagcaaaagacctctaatccgatcattttactgttagtaaacagctgaatatataggcacaagtatgttcattataactgttacttatcatggtgaaaacagtaaaagacagttaaacccatgtgaccaacaacatttattattacgacttttttttttagagatggggtcttgttatgttgcccaggatagttagtcttgaactcctggcctcagtgatcctcccaccttggcctaagtgctgggattcaataacaattattttaaaacaggcaatgatatgagaaaatgtttatcttcagcatccatgtaaagggcagattatgaaacacttgtgtttagtgtgacacccaaattcactaaaaaatactctcctacatatacagacgctaacagaaaagggaaaaaagtcaaacttcaaaatgctcacaatggttctctgaagagtagaaatgtggccatttaaattgtttttatcctttcctgtagtttccaaattctctaatcaacatgtattatttttataacagcaagaccgttaaaacagtaatgcagtcaactcagattccagttctattattctgactcactgagctcatcttaaatcttagcaatgtgaatggaaaaaaattctgttttcgcctggcaaagcctttaaagttccatgaagtcaagaagcacatatagtactaacactggcacaacaatggtgccaggcaaagaccctctaaactcaatacataacggagcaccatatattagtgcaccctacatcattcttcagtgcattcagcaacttgagcgtaatttgatctaaaactggccaaactccatatataatctttcaatacaacaatcagtgaaaagacagaagacaaatataactcagccagaatcccagtcccattttcaagctatgtgactggcaagtaacttgacctctttaaatcatcttaaactcatactcaatagatatttttacaggatttttagtattactagagataatggatggaaaatgcccagcacaaagccaggtacactgcaggtgttcaataaacagtagctactgtgatttaccatctacatagcagacatccttcatgtaggacaaaaccaaagacatcaggatgtccaggcgctcggctacaggatgcaccatctggtcgagccgttcaggaccagcctttgtttcatgttcagtttcttcatcttcatcctttgaagacaaaaagtaaatactaacattaaaaaattcaatgtcaaagtggtttagtaggaaaactgtcataagtgattatttcccttaaaagataaaacaaagaggctggggaaagcggctcacatctataagcccagcactttgggaagcagaggtggggggatcacttgaggtcaggagtttgagaccagcctggccaacatggtaaaactctgtctctactaaaaatacaagaattagccaggtatggtggtgcacgcctgtaattccagttactcaggaggcagaggcaggaaaatagcttgaactgggaggtggaggaggctacagtgagccgagttcgtgtgctccagcctgggcaacagaggaagactctgtgccccaccaaaaaaaaaaaaaaaaaactaaactaaaacaaagaaatggaccacgcacagtggctcacgcctataattaccaacactttgggaggccaaggcaggaggatcacttgagctcaggaacttgagaccagcctgggcaacacagtgagacctgtctctacaaaaatagaaaaaaagtagctgggtgcggtggtacactgtagtcccagctactcggggaggctgaggtgggcagatcacttgggcccaggaggtcgaggctggagtgggccaagatcacacactgccacactccagcctgggcaacagagtgagaccctgtctcaaattaaaaaagaaagaaaagaaagaaagaaatgcagacacctttccaggcaggggtctcattcagggatgtgaatcagaaccaccagtgaaatttaaaataaaagccaagactcacagcaccagcttctgattctcattgagaagacccaatgagacctatccatgcaaaaatcacagatgccccctacctctgctcctggtgcccaccatggcgggtgcttttggtgccgggcccccttttgcaggtcgggatatccacctccccactgctgtgagtactggcggccaatagctcacagccgcctactttctccagagctgccctgagcagaaaggagccaggaccacccttgcactctttccagcccctcccccttagaaccaatgactgattgacaaggcatcagaaaaggacatctccttggtctcaagctgggaacaaactctgtagaccaatccatgccccagaatgcctggtgggagcaggctgtagcgacctcccaagtgagacccggcccccgtttagctcccctgccctcttctgctccctgacaccctctgtcccaagggcacctgaatccctgtctcagactctccttccactgaacccaacttcagataccacccaaaagaagtaatgctataaagtgtacaagtggtaaaatgcagaaattaaacaggtatgcttttctattaaccacgccctcacagacagcatctggcttacaaaaacaaacactgaaagttacaagaacaaaagtgaaacatacttcaccaaacccaaattcaaagccttggaaatagaccaactatgctaagtgctaaatgacatggcagcaaattactcatataaggaatcgttttcaagtttgctgaactattttaattctttcaatctaaagccttaacaaagatgagcagcactagctgtttccaccctttatgataaacttcatctccactttcattaataaactgctaaccatattaaacaatccttccgtggaatctgtcccaccacaagtttgagttgctgtttcttcagcatcttcaataccctgccgggatgcattcacctataacaaagggagaaaaaaaaagaataaaaggatttaaaaaatacaactatgttattttgggatggaaattcatctgatatacgcatgttcaaggtgtccagattagtgccttatatcacaccccaacacaatacacaattatggtgcaagcctgtaaactgacctaggtcatgaaggaatttaaatataataaaccaagccccttttactacatacttatataaaatcgacaactatcacatgatgctctatgccaggcagcctcaacaaattcaacatttattctagctctgatatggtctggctctgtgtccccacccaaatcacttttttttttttttttgaggcagagttttgctcttgttgcccaggctggaatacaatggcaagatctcggctcaccgcaaactccgccccccaggttcaagagattctcctgcctcagcctcccgagtagctgggattacagtcatgtgccactgtgcccagctaattttgtatttttagtagagatggggttactccatgttagtcaggctggtctcgaactcctgacctcaggtgatccaccggcctcagcttcccaaagtgctggaattacaggcatgagccaccgcgcctggccccaaatctcatcttgaatcgtactcctcctgtaagtcacacatgttgctggggggggactggtgggagataatttgaatcatagggtaggtttcccccatactgttctcgtgatagtgaataagtctcaagagatctgatggttttatcaggggtttccacttttacatcttcctcattttctcttgccgccaccatgtaagaagtgcctttcacctcccgccatgattctgaggcctccccagccatgtggaactgtaagtccaattaaacctcttttttggccaggtgcagtggctcacgcctgtaatccgagctctttgggaggccgaggtggacggatcatgaggtcaggagattgagaccatcctggctaacacggtgaaaccccatctctactaaaaatacaaaaaattagccgggcatggtggcatgtgcctgtaatcccagctaatcaggaggctgaggcaggagaactgcttgaaccccggaggtggaggttgcagtgagccgagatcgcaccactgcactccagcctgggcaagaagcgagacaccatctcaaacaaacaaacaaaaacatctctttttcttcccaggctcagctatgtctttatcagcagtgtgaaaatggactaatacaatctctatgcacaagacactcacagacacattgtgtaataaacatatcgtcaatcaactgagcagaaaaatgatgaactgccagccaaatgtgcatgatgcaatatttattttggtatatcaccattcaaatatcttaacataccactcaaaccatgccattttttattatctatgcttgaccttctttgtaaacattctaaaatgttccttaagtatataccagagaaagactataaagagtacatatacagttggccagagaggtgcaactccaagtgagcactgcaccagtgagcccaagctccagctcttctgagaccttgttccatcttcctgctttcctatagcatcaatgttttcctccaccaaagctcctctcccctcagtccacaaacctgctcacgtctctccactcctaaaccacgcctcttagccctgctccatcccctccttccaccacaaccctgcaccaaggtctctaacagccccaattctgcttccccaccatccacatcctctcccgaaatgcagtttctgcgtcttcactgacatggtcctccagaaagcaacaaagactaccttctaaccactaaatccaaggactgttgctcttttcatctttctaaaaaatgacagcagtatctgatgctgctgaccaaactcctccttccggcggatccttcctgagcatccaggctcttggttttccccatacttctgatcacccttctcctcccctgtcctaaactgcatctttccaaaggtttatgctcaggtccccatctgcagccacgactgcctgtgagtattctctggtaggctgcccaccagcaactgaacctggccaagatggaactactcttccaactgcctcctcttcgtatttttttctttttttttttttttttgagacagagtcttgctctgtcacccaggctggagcggagtggcgcaatctcggctcactgcaagctccacctcccggattcacaccattctcctgcctcagcctcccgagtagctgggactataggtgcccaccaccatacccggccaattttttgtatttttagtgagacagagtttcaccatgttagccaggatggtctcgatctcctgacctcgtgatccgcccgcctcggcctcccaaagtgctgggattacatgcgtgagccaccacgcccggcctcctcttcatatttctaactaccattaatggcaacaccaagattcaattccacagggagcaaagttgaaggattcctttcccttactgtctgcctcccctcctccaaaccagtctcaagcaccagttcatctttcctgacaatgtcactagaatctactacttcctttcattcccactgcaccttagtgcgggcctccttaaacaaagttttaactgtttataattataatctgcccttaagaaaggccaaacaggaaaaatcacttccgtaagaatcccttcctgaccccactgtgattctatcaggttctctaactcataatgtatgtttcattcatagcattttccacaaccatacttttacatttggataactatgtatttaacgccttgttctccaatcatgagaaggaactgtctacaactcccagcacatgcacacattcaaagaaaggaagcaaagaatggtgctagtggtttcttttcttttttttttttttgagatggagtctcgctctgtcgcccaggctggagtgcagtggcacgatctcagctcactgcaagatctgcctcccggattcaagcaattctcccacctcagcctcctgagtagctgggattacaggcacccaccatcatgcctggctaattttttatttgtatttttatagagacggggtttcgccatgttggccaggctggtctcgaactcctgacctcaggtgatctgcctgcctcggcctcccaaagtgctgggaatacaggcgtgagtcaccacgcctggccaagtggattcttttctatcactgactattgtttccacatactgtgattataacaaattcaagtcagtaaatgaaaataaaaatagattactcaatacttacatccaacttgagtagtttttcaataataagctccagaatttcatgcctcaaggttggaaaatatacactaatccttagtaagttatgaacgtaacattcctaaaggagaaaatgtaagataaaacatttcaacagagaataaacgtttcacagttatgtaagcaaaacatcaattacatgacctttagtttcaaatatttaaaaagaaaaaaacagactatccagcaatacaaaaactatactgtttctacatgtattatgttcggtataatcatttcaattattcccagtaaatgaaatttttaatttgcataactataggtttttaagtagctgtattgataaaactcatatatcatacaatcaccaacttaaagtatacaatttaagtttttaatatattcagttatgagaccatcaacataatcaatttcagaacatttatttttcttttagagacagggtcttgctctctctctcaggatggcgtacagtggtgcaatcatagctcactgcaaccctgaattcccaggataagcaatccttcctcctcagcctccctagtagctagaactacaggtgcacaccaccacatgaggttaatttttccttttagagagacattttctcactatgttgcccaggctggtcttcaactcctggatcttcccacttcagcctcctgaagtgctgtgattatgggcataagccactgcgcccagccagcaattttgtaacattttaatcacgctaaaaagaaatcctacatccattagtgcacccctaaaaaatgaagaccttggcaaccactagtctttctatgaatctgcctctttgacatttcatataaatggagtcatataatacatgtttttagggttcaatcatgttgtaacatgtaaaccattcctctcatatcaatggagtcatacacagtttgtggcatgtttttagggttcaatcatgttgtaacatgtaaaccattcctttcatatcaatggagtcatataatacacagtcttttggcatgtttttagggtccaatcatgttgtaacatataaagcattccttttcattgctgagtaatattccattgtaccatgttttgtctgttcatcagttgacagacatttgagttgcttctacttgaggctattatggatgatgctgctatgaccatccatgtacaagtttttctgtggacatatattttcatttctcttgggtataaacccagaaatggaactgctgagtcacgtgttaattctacatttaaccttgaagaaatgccaggctattttccaaaatggctgcaccattttacattctcacagcaacatatgacagttccaacttcccatttctccatatccttgtgaacacttgttactgtcttctcgttctgattatagccatccttgtgggcatgaagtgaaatcatttccctgatggctaatgatgttgagcttcttttcatgtgctttttttgcagaaatgcctattcagatcctttgcccacttcagttgggctatttgcccttttattattcaattataagagttctttacatatacaagtccattaccagacataaaatttagaaatatttcctcccattatttggggatccttttcatcttcttgaagatgtcctatgaagcataacaacgtttaattttgaagtacaattgatgcatttttttctttggttgcttgtgcttaggcatcaaatctggaaattactgcctaaaccaacatcatgaaaatgtactcgttttcttctcagagttttacagtttttactcttcatgtagggcttttattgagttcatttttaaatatggatatccatatgcttcattcttttgcatgttcatatccacttctgccagcagcatttgttgaaatgactattctcccctattcaattgtcttgaacaactggttagtgtatgttagtcttctgtcccgtaaccatgctgaactcatttattatctctaaaatttcttgtgtgtgtgtaaactccttagaatgacatataaaatcaccttgcaaaagagagtttacgccttcctttccatctggatgcttttaattctttttcttgcctaactgccttggctagacaagcagcaagagcggacatccttgttttgttctttgtcttaggaaaaaacttttggtctttcaccaatgaatatgatgttagctgtgggtttttcagatgccctttatcaggttgagaaaatttccttctgtttttctcgtaaaaggatattggtgtttgtcacacacttctgcatctactgagatgattatgtggtttttgtcctttgttctattgctacaaaatattttattaattcattttcaggtactaactcaatctcggccggtcacggtggttcacgcctctaatcccaacactttgcgaggtggagacgggtagatcgcttgaggtcaggagttcaagaccagtctggccaacgcggcaaaatcccatctctaccaaaaacacaaaaattagcggggtgtggtgccccatgtctatagtcccacctactcgggaggctgaggtgggagagtcacttgaaccctggaggcagaggctgcagcgagctgagatggtgccactgcactccagcctgggtgacagacggagactgtccccccacccctgaaaaaaaaaaaatcaatcttgcattcttaacatcagtcgcacttggtcatggtacataattctttttgtatgctactagattcggttttctactaaggcaaccactattaattattaaaaactgcacagatgatctgaacattgtacaaaaacttaagcagaattcttctatggaaggctttgtcttcaggttaaaataaggcatgttcacaattagtaatacatgaactattatcttctagtaattcttgtccatatgagcataaagccactacagatattcctgaaatgaactcagaccttgacttgcacatagtaataacagaaaaaggcactgggaatccccaatagccgctttataagaaaggaatctgagtcaaattcttagacgtcagtttaaagtctagaagacaaagtaacctttaagaaaaagacctaacattagctgggcacagtggttcactaatcccagcactttgggaggccgaggcaggcagatcacaaggtcaggcgttcgataccagtgtggccaatatggtgaaaccttgtctctactaaaaatacaaaaattagctgggcatggtggtaggcgcctgcagtcccagctaatggggaggctgaggcaggagaatcgcttgaacccgagaggcagaggttgcagtgagccaagatgacgccattgcactccagcttgggcgacagagtgagactcggtctcaaaaaagaaaaagaaaaagaaagactggaaaagaaagaaaaagacctaatatcatctaaaatgaaatcgtacaaacaacttttccatgatgttctcaatgaaaagatttcttaccagtgttctctctgattttcgaacaaatggaaatttttccaccagtattggcatgagaaaccacggtgtcctatttttaaaaaattaaatcaatccatgttaactttactttctagaaaaggaataaaaaggaaaactaccattctaaaagcaaatattgatagacataggaggcaaacaggaacccctacctcaaagaactggaactttttttgttttttgagacggagtttcgctcttgttgcccaggctggagtgcagtggcgcaatctcagctcactgcaacctccgcctcccaggttcaagcgattctcctgcctcaacctcccaaacagctgggattacaggcatgcgccaccatgcccagctaattttgtatttttagtagagacggggtttctccatgttggtcaggctggtctcgaactcccgacctcaggtgatccgcccgcctcggcctcccaaagtgctgggattacaggcgtgagccaccgcgcccggccagaactggaacttacaatgtatagcttctgagaaaatctataacgacttagagaaaataaggttctgttaactctgatatcaacagcaaatcaaagagggagcttctctcccacagaaacataacagcacttttgctgacatttcccactacacatgtatattatttttaaaagaagaaaaaatcatcaagttggattttttttaagttaacaaataatcaacggacagagggaactagaggtccacccctccaaaagaaacccacaaacctgaaaagcttttcttagaagtgcaatttttattcatatggcatgacacaaacacacccaggggtttctcactgaaaaattttggatagcatatctgttgaagataaaagcaaaattccaaccaccatacaaaattgggggaggatctgcatacaaactttgaaaaacaattaaagagaataaatagaaaatggaaatgccactttttgtagaatgtaatgtttcctcaagtggatacaaaaaaaacatgcaatgtaagactcaagctttaatactattaacattttataatttttactaattgattacaattttcttgagaattaaacattcaaaataaggaaaagtatactcacgatggtacatatcttgctattatttgcaaggctctgtgacatgtgtcaaaatttgcaggaagatctgaaaggagaaaagttcagagtatgagcatcaaaacaaaactgaagggcgacacgcttgaagctaaaaataaatgctggctgggcacagtggctcacgcctgtaatcccagcactttgggaggccgaggtgggtggatcacctgaggtcaggagttcgagaccagcctgaccaatatggtgaaaccccatctctactaaaaatacaaaaattagccaggcatggtggcaaatgcctgtagtcccatctactcaggaggctgaagcaggagaaccacttgaacctgggaggtgaaggctgcagcgaaccgagatcacaccactatactccagcctgggcaacagagcgagactctgtctcaaaaaacaaacaaacaaaaagtgacatacttgaagctaaaaacacatgctaaccaaaacggaataatttatcagagaaataataatttcaagatttttctccaccagcatcaacgaaaattaaatggactaattatataaataatgcattcaggacaaatgactgcatatcaatggtaaatataacaaaaagattacatcaaaggttgtcatttgttgcagtctacttattagaataggtgccaggtattctgtgctttacttttttttttaaagaagacagtgtcttgccaccaagcagggcttgaactcctgggctcaagcaatccacccacttaagcctcccaggtagctgtgactaaagacacacactaccctgcctagttctactttaagccttttttaagaaaatatttgaaaaaaaatgtttttttgcagagacaaggtctcactatgttgcccaggctggtctcaaactcttggcctcaagtgatcctcccgtcttggcttcccaaagtgctgggattatgggtgaaagctactgtgcccaggctttaaacctttttatacttactatcatcttcatcatcagaatctgaaacatctacatcgccttccttaatgatcactcgggcttttgagggaaaaagaaaatatgttattctgtcattgatctagacaatgaatggctatacaaaaaaagttactgacctagacaatgaacagctataaaaaaagttatttttccataatccaaagttagcccaatgattaattaaacgcacaatctgaaaaaaagtaaagcaactttatagtttttaaacggctaaaaattcctagatttcaccaggagttcaataaagcaaataaattcataaaactcacagcaacaaatgaatctagacacctccataggggtcattacggggaatatatgtctaccagacctggtgccaatatgcatctggaatcttccatggtagcagtctctcatatataaggggaaggtagtattttaataaagaagtattaaaaagaaaataaaattccaagcaatgacttacgaggcacaaaatgggaagcaatcatgctgagacacggtctgaggaaaacagtctgtgctgatacaagattaccaagaaaagccaaatactcttccactactgtttgacttctattcaaccaaggcaatctctagagtgggggaagaaagataaaagcagcatgttattaatataacatatactattaccaaagttctgaattacatactttacagtaaaataaatggtgaacttactaatataatactgataagttgctcaaagtcttttgtcaagtacatgatagaagaacggaattctagcagccagttgatgatctggtcatccttaagttaaacaaagagtactttcaaaatcacaaatcctctaacataacagaaatttacagctatcttatatcaatcatttatcaagaataggttggggggaaaaggtcacaaacttggaaggaactcaaaactgggtattaaaacagaaaaagatgtcacaataaattacttaactgttttaagaaagtaatctagtaactctaatacacaggagaaagacttaaatgcaatacttcagcctgatcacttctgtttgccctgaaaaagcgaaatcacctcaaatgttgacacctgggacttttaaaaactgcagcattctagcagactgaaatattagaagatcacaaaggaacaatagctacctctatttcctctatattcaagctgaccaggaagcatgctgataaaactcagtcgaggctgatcaattggggtcatgaataaacataacttttctaaaccaaacctgtggctgagtttaaatatattatgatgtgattgttctgtataaatgatagccccattcctccatgaaatatttttcgggcaatcaaattactgttcatagtaattgttagtgacatgagaagaactgctaaatttgaaacgcaatgtataaaatacagtgtcaattatgtaaaatattactatattaattatattcatgcatatatactgcacaggaaaaaaaccattaagaaaaagcccctaatttgtggaaggcttagacatataaataaaagcaacacaaggtcatacctacagggatattcatatggagttatcatttagtgagaatacaccatatgccaggcatggtgcctgacactccacatatatatcttcttctaatcctaaaaactctgcaagatgtttagttattcccattttgctgttcaggaagctgaggctaagaacgattaataagcaatctgcccaaccaagaggccagtaaagaagcaggtccaaacccgtctgtctcggtcaaggctatcctctgtccaccgtcccacacgcctccctatatgcggagaagaagctgtccccttttccccaccttaattcagctactgagtgcttactatgccatatccatgtgtcaaactcccacagatcaaccattttctgatgaaatcccaagtagcctggcagtaaaataaagtaaaaccacaactcatttgtactatggtaatttcatatgtccacaactgttaaggataacattaacggtagctcactaaggccaaaggcatgtagaaaacaagctaagttagtgtacaaataaaataaactatcctatctcttttccactaaaaagactgcaacaaaactataaggataacatttaaactgtaccatttttaaaagtaaatcaggctgggcgtggtagctcatgtctgtaatcccaacactttgggaggccgaggtgggtggatcacctgaggttgggagttcgagatgagcctaaccaacatggagaaaccccgtctctactaaaaatacaaaattagctgggcgtggtggtgcatgcccgtaatcccagctactcgggaggctgaggcaggagaattgcttaaaaaactcggaggcagaggttgcagtgagccaagatcatgccactgcactccagcctgggcaacaagagcaaaactccgtctcaaaaagaaaaaaaaaaagtaaatcagttgcagactttgatgctttagtactgaactattattatttctactagcaggcaggaacagtggctcatgcctgtaatcccagcacttttgggaggccaaggcaggaggagactgcttgagcccaggaatttgagaccagcctgggcaacatggggagacctcatctccagaaaaattagccaggcatggtagcacatgcttgtggtcccagatgctcgggagcctgaggtgggaagattgcttgagcctgggaggttgaggctgcagtgagccatgatcgggcccattacactccagcccgggtgacagagcaagaccctgtctcaagatggaaaaaagttctacttgcaacactccacacaactagtgcaattcttggtatgtcaaaataccaagaatgagaactgctgatacaaaatacagtggaacacaaagaaaatgtccctttgtatctgggaaagaaggcaggggtcaggaaaagctttaaagagaaagtgatgcttcagctgtctttaaacagtaacacagttgagtcttttctggaagttctgcttcttacagaaggaaaagtatgttttcagaaaactgaaaaacgttcagtatggcaggcatgtatagtgaccaagccaacagataataaatctggggaacaaagaagcaccaaatagaccatggggggccttgtaaaccagatctgtaactagagagatctggaagtgtgggaaatggactcaatgaaggaacaaccatgtgcttagagagaaccagggaaagctccatgaaagatggagcccagccaagagtggacatgctaagtttggagcatctatgatgattctgggtaaatgcatctaacagacagttaagaaacaagtctaggccgggtggagtggctcacgtctataatcccagcactttgggaggctgaggcgggtggatcacttgaggtcaggagttcgagagcagcctggccagcatggtgaaaccccaaatctactgaaaatacaaaaaaattagctgggcatggtggcacagctactcgggaggctgaggtgggaggatggcttgaacccaggaggcagaggttgcagtgagccaagatcatcccactacactacagcctaggtgacagagcaagactctgttctgcccgtccccaaaaacgaaaatgaaataagtctggagcccacaagagcaatcttggctacagacacaaatatattaggacacaggtagatttcaaagccatgaagggagatgaggagatcacacagaagaatcaacagagtgagaaaagagtcaagttttgaagcccaatcaacaccaaatttaagatcaagaaactatcaagaaatactagcgattaaaggatcactggccgggcgtggttactcacgcctctaatcccagcactttgggaggccaaggcgggcggatcacgaggtcagaagatcgagaccatcctggctaacatggtgaaaccccacctctactaaaaatacaaaaaattagctggcggtggtggcgggcgagtgtagtctcagctacttgggaggctgaggcaggagaatcgcttgaacccgggaggcggagcttgcagtgagccaagattgcgccactgcactccagcctgggcgacagagcaaaaaaaaaaaaaaaaaaaaaaaaacagattaaaggatcaggagacaggaggatcagaaacgctgaagttttaagaagtgggtggccaacagtgtcggctgatacaaggaatacaaggcttaaaaaagtaagtccactgaggctgggctcagtggctcacacttgtaatcccagcactttgggaggccaaggcgggcaggtcacctgaggtcaggagttcaagaccagcctggccaacatggtgaaaccccgtttctactaaaaataaaaaaaattaaccaggcatggtggcgggtgcctgtaatctcagctatttgggaggctgaggcaggagaattgcttgaacccaggaggcaaaggttgcagtgagcccagatcacaccactgcactccagcctgcgtggtaagaaggagactttgtcttaaaaaaaaagtccactgaaatcagcatgtaaaaaaaaaacatgggtaacctgtcagggtaattactacagtgataagaacagtggacttaaatgtgagtgagaaatgatacagcgcagtcagctggaacaaaaacaacagatgacaattattgcccttactttgagtcagagactgttctaagtgcttcttgcatattagctcattgaatccttgttaagtatttccatgtttaaagccaggcactttaaacatggcatgcacctatagtcccagctttttagaaggctgaagagaaaggatcatttgaggccaggagttcaaggctgtagtgcactatgatcacacctgtgaatagccagagcaacacagcaagaccacatctcttaaaaacaaaacactccatattttttaaatctctattgttttcttggtttcacacagtggaaaatagaggcagagaggttaaaacaatttgctcaagatcacacactggataataaaattggaatttcattccaggcaatctaactaccactgccatagtaataaaccattctcttcaaaactgggcagtaaaggaagaatggtgaaacaaaatgcattcagcttttactacatgataggtgtatctcgaacctggaaatgctgaatcagtggtttgttttttttttttttttgctttgttttagctttaaagagacaagagagttgcatgcagcatggaggaaagaggtagtaatctaatagaaaggaagcattagagcagggtttcccagcctcaacactgttgtcatttggggctggatcactcttggttctgggaggctgtcctgtgcactgtgagatgtttagcagcatctctgtcattcacccactagatgccagtagcaccctttcctcccagttgtgacaaaaatatctgcagccatcaccaaatgtcttctagggggtaaaactgtccctggttgagaaccaccagattaaaataagggaggaccatggagagagcaagttctggaggacagaatgggacccaaagagcaaactatgtctgtatacagtggcaataattttgctaatgatcaaacacaaaattaattacctttatgtctggatctaacagctggttcttcaacaactcaaagtcatttgtttcacccttaacaagaaggggaaagaattaagttatgcttttgtttcctgtttagtatcaacagcaagacttttaaccgtactttaacatcagatgaaattataaaaggaacactaactttcacatgtcaattgcggattataaaatcatgactacaaaaatttaaacactcatgttagtgcagccagagggcttggaaaaaggaaaatgataaactacatttagctatacttctgtattgacatttgaatataatagttgatactcctgcgaattctcaaaaagcatgagggaaaaaaacagccagctataatgatctaattcaggaggatctaaaaaagtattcactcaaatatggatacaaatggatattacatataaacatatggttacttaacattttccctctactgctgagatacagtagaaatgcttctaaactaccacaaaaacaaaaatccctactcagagaactggtttactgtcccaaagtaatgcttaggtaagttcctcaaaaaataaaatgctgtaggccaggcatggtggctcacgtctgtaatcccagcactttgggaggccaaggcgggtggatcacaaggtcaggagttcgagaccagcctggccaacatggtgaaaccctgcctctactaaaaaaataaaaaaattagccaggtgtggtggtgtgtgcctgtaaccccacctattcggaagactgaggcaggagaattgcttgaacctgggaggtggaggatgcagtgagccgaggtcacgccactgcactccagcctgggtgacagaggaagactccagcacaaataaataaataaataaaatggtgtaattgtttttaattctggcacttgctaaagttaaaagatgcttcgtaaataaagcatttgaagaggtgaaacctcagtaaagacattattactctctcattattacctgtgaaatgggccaaggtgggggaaaaaaaggacactattactctaattttgcactgacggcatcatgctattattaaatatttgatttcaactggtatcttaattaatcttgctatttctattggtctttagtataacagcaatagttgtattctgacctaaccaaaagcaaacctcacacattatctccccttacctttttgtacttcagcaagacttctgtcacagttccaccaaaccgaacagtttttcttgggggagaattgaaaaagtcattctctaatgcacgcatatttgaaatcctgtggaaccaagattaacaagctattaagttcatgaaaataataaaaattataatagccaacatttattgaaccaacataattcagtggaactattgttaaggcctctttactggtctccctgcttccactcttaaccaacaatccttcctttgctcagcaaccaataactgtcttcccactgcacttacagtaaaaatccaaatctctcagtgtggtctttaagatcctacattaatctggcccctgcctacctctctcacctcatctccaacaacttgttttactacagccataacgtcttttctgctcttcaaacaagccaagctgtttttcatttcacttactgttcactctattggaaatactcttttcccaaatctctacgtggctggatttttttttttgagatggagtcttgctctgctgcccaggctggagtgcagtggtgtgatcttggcttaactgcaacctccatctcccgggttcaagcaattatcctgcctcagcctcctgagtagctgggattacaggcacctgccaccatgcccggctgatttttgtattttcagtagagacgaggtttcgcacgttggccaggctggtctccaactcctgacttcagatgatccgcccgcctcggcctcccaaagtgctgggattacaggcgtgagcaaccgcgcccggcctagatttttgtcttcattcaagtggaagctcaaatgacagatgtcttcccaatgagaaatctcaaaagctccttctctcccttctccctcccccattaccttgttgtataactgaaatcatcgtgttcgtttatttattggcctatgtactgcctttcccccctatgctgtaagctctgtagaaagcagggacattagtgtctttggataaaccactgtccccagtgtttaacacagtaagcaggagctcgataattattatgaatcatattacgctaattgttttacaaggtttgcttcacttacacgtagtaaattaatgaaaaaacatagcatcctaatgactctgaaagttaaacgccaagagtgctacgggggttagggattttaaaagtggagcaaaataaagactgcgaaacaaatacgtgtgtcgaaacaaattccaaacaaaaaagatgtaatattcaatttgccatgagtgacgacgttcggctgataacccacatagcccagggaaatcccttccaaatttggacgaagaagagggaaggaagaggggtcaaggcgcagaaggcagtacccaggcctgggaaatcacgaagagacacagtcgggaaagggggcctccagaacagagaacatagtcacttttccaggccccacccatgtctattacccagttaggaggaatgagctcatttctgtgaacgtgagatgaccctccaccccgtgctcctatcacacgccatgagctttgtcccacatcctttcaatccgctcctctaagcgccgtcctgagctttcgtcccagatacgcagaaggaagcggcctgaatcttacccagtcctcgacgcgcccagcttcttaactgcagaggacgaagcggccgcatctcccggcaaacgcgtgtgaagcagcggtgccgccattgggccgaactaacgcgaccgctgcgcctcaggccggatgcccagctccttccagccacagcctctgtcccggaagttgcgcgtgccagcgcaaccttcagccaatcagcggccccgcgtggggagggcgtatgctctcggcgggctagagcgccgctgaaacccgctcctcgttctacttggaggacttgttccagccagcgctagtgcgtgagtataaggagagacgggaaggaccggctccatccagccctgaggatcccgaagaaagggtggaaacaccctggatgtgctaagctgtggccgggtacactcaagtgttaattttttggagtcaaagcctccctcagtcaaatcgaagaaactgaagcacttgtgactgacccagatcttcacggaggaaaggggattcgaacccggctgacccaggagcctgggctctatactcagtgcagcagtctcacagacacccaagataacgttatcctcacggaaacgagctcgacgaagtgacctacctcagagcctcaaggctatggtgatgctggcatgagaaacaacaggagagttacgaagaggtgttacccccttgactttatttatttatttatttattttcttttgaggccgagtcttgcccttttgcccaggtggagtgcagtggtgtgatctcagctcactgcaacctccgcctccccagttccagcaattctcgtgcctcagcctcccaagtagctgggattacaggcgcatgccaccacacccggctaattttcgtatttttagtggagacggggttgcactgtgttggccaggctggtctcgaactcatgacctcaggtcatccgcccgcctcggcctcccaaagtgctgggattacaagcatgagccaccacgcccggccaaacttaaatttttaaaagaggaacaggagtcagccagaccaacaaaagagccactggcgttccaagcataggaaacggaggaaacagaggccaaaacctcgggactgtggaggatgtagagggagagcaggggctgcccctactctcagggaggggaaaaggttgcaactttggaaactgtacaggcctatcaaaaatacaaaaatatccagcctgggtgacacggtgaaactccatctctacaaaaaatttaaaaaataaaaataataaaaattatctgggtgtggtggcacacacctgtagtcccagctactcgggaggctgaggattgcttgagcctgggagatagcaccactgcactcctgcttgggcaacagagtgagaccctgtctcgaaataaataaataagtttttaaaaatgcatatgtatgggcccggcgcagtggctcacgcctgttatcccaacactttgggaggccgaggcaagtggatcacctgaggccagaagtttgagaccagcctggccaacatgacaaaaccctgtctctactaaaaatacaaaattagccaggcatggtggcagtgcctgtaatcccagctacttgggaggccgaggcaggagaatagtttgaacccaggaggcagaggttgcagtgagccaagatcgtgccattgcactccagcctgggtgacgagtgaaactgtgtctcaaaaaaaaaaaaggtgtgtgtgtgtgtgtgtgtgtgtgtgtgtgtttatatgtatctctctccaggagttcaagaccagcctgggcaacatatggtggtgcatacctgtagtcccagctacttgaaaactgaggacggaggatcacttgagccctggaggtcaaggctgcagtgagctgtgattgtacccctgcactccagcctggacaacacagcaagaccctatttcacaacataaaatacagcaatttggtttttttgttttttgttttttttttgagacagagtctcgctctgtcacccaggctggagtacagtgtcatgatcttggctcactgcatcctctgcttcccaggttcaagcgattcttgtgcctcagcctccccagtagctaggattacaggcatgcgccaccatgcccagctaatttttgtatttttagtagagacagggtttcaccatgttggccaggctggtctcaaactcttgacctcaagtgatccgcccgccttggcatcccaaagtgctgggattacaggcatgagccaccacgccccgccagcagtttgttaaacataaaccatagctctgttttgcaacagtgtaaaatcagtaactgtctttcctgagtctctatttggtccttactgagttccttgggaatgttggacaggaatcatctgtgtctcaaggacagaggaaataattgcaccgtagctcacaaagatacttcaagataactgtttaaatgagaatctcttcttcacttccaagggaaagcaaagcaaaaacaaaaagcaacaatagcaaaacagcaatctgacaattatctgttttgttttgttttggtttgagacaggatctcattgtctagcccaagttagagcgcaatggcgcgatcatggctcgttgcagcctcgggctcctacagcttatgcaatcctctcacctcagccgcccgaacccacaccaccaagcccagctaattttttgtatttttggtaaatacgaggtctcactttgttgcccaggctggtcttgaacccccggcccaagtgatcctcccaccttggcctcccaaagtgtgtctccccacctacactcccattctttcccttaaaaaaagtctgagtctgggtgcagtgactcacacctgtaatgccagagctttgggaggctgaggcaggaggataacttgaagccaggagtttgagaccagcccaggcaacacagccagactccgtctctacaaataacacttttaaaaaacttacccaggcatggtggcacgtgcctgtagttccaattatttgggagacagaggtgggagaatcacttgaacccaggagttggaagctgcagtgagctatgactacaccacgacactctctggcctgggtgacaaagcaaaatctcatctcttaaaaaaaaaaagggaaaaaaagcttgatatgtacaaaataatatgttaatgtaagttataagaacataatgggccagacacagcggctcctgcctgtaatcccagcactttgggaggccgaggcaggcggatcacgaggtcaggagatcgagaccatcctggctaatgcggtgaaaccccgtctctactaaaaatacaaaaaaaaaaaaaaaaaaaaaaaatgtgccgggcgtggtggcaggcacttgtaatcccagctacttgggaagctgaggcaggagaatggcatgaacccgagaggtggagcttgcagtgagccgagatcgcgccactgcaccccagcctgggtgacagagtgagactccgtctccaaaaaaaaaaaaaagaacataatgaacacctgtgaacatatcgcccaatttaagaagccgaacattaactaggacaattgacacttactctgtgctgctctcggatcccaccttctacctgctttcctcccaaaaatagtcaccatcatgatttttaaaagtcattttagttttctttgaataattatcatatttatactcctaaacaatgcactatatttacttttatttgtctttgcattttataaagttatctccatgctgtattatactgctgtttgttttcaacattatgctttttttttttttttttttttgagacggagtctccctctgttgcccaggctggagtgcagtggcatgatctcccgccgtcctcccacctcggcctcccaaaatgctgagattataggcatgagccaccgcgaccagcctgaatattcttgtatcatgtcctgatgtatgtgtacaagtgtttttctagggtggaactgttgggttggagggggcaccaaaagcttttaggaaaggagaaaggaacaaattggatatctatgattttttttttttttttttgagacagagtctcactctgttgcccaggctggggtacagtggcacaagctcagctcactgcaacctctgcctcccgggttcaagcgattctcctgcctcagcctcctgagtagctgggactacatgtgcccgccaccacacctggctaatttttgtatttttagtagagatggggtttctccatgttgcccaggctggtctcaaatgcctgacctcaggtgatctgcctaccttgacctcctaaaatgctgggattacaggtgtgagccatcgtgtctggctactattagtttttctatttagaaattgttcatctggatcctccctacctttcagccatttgcaatacatttgttgagcataaagagtgaccttcttggccgggcatggtggctcacgcctgtaatcccagcacttttggaggccaaggtgggtggatcacctgaggtcgggagttcgagaccagcctgaccaacatggaaaaaccctgtctctactaaaaatacaaaattagcctggcatggtggcacatgcctgtaatcccagctacttgggaggctgaggcaggagaatcacttgaacctgggaggcagaggttgcagtgagccgagatcactgccattgcactccagcctaggcatcaaaactccctctcaaaaaaaaagagcaactttcttgtccacagcaaagaatcactggaagccatttgatgcaatatgacctcatctctctagccagtgtcgattgggttacaggagggcaccaagaagctttttgaaggctgtgccaatgtacacttccagcaatatcttcttaagcttgagtgcagctccttattttcccaaagcacagctaagactaaggctgccaagtttttaaaaagatttaaaggaaactctgagcattatacaagaaaaatactggccgggccctgtggctcatgcctgtaatccctgtactttgggaggctgaggcaggtggctcacttgagatcaggagttcaagaccagctgggccaacatggtgaaaccccatctctactaaaaatacgaattagcaggtgtggtggcaggtgcctgtaatcccagctacttgagaggctgaggctggagaattgcttgaacccaggaggcagaggttgcagtgagccaagatcgcaacactgcactccagcctgggcaacagagcaagacttggtctcaaaaaaaaaaaaaaaaaaaaaaaaaggagaaaaagaaaaccttaaaactaaatgcataatttctgttgtaattctttgaccatgtccgttctttgtggagcctctattcagtcaaattgtcctgtgggccaactcatcttggcaggataaaagcctccttatccagtcttgccttccccagagaaaataaagggggtgggggagggataaagaaaattaagaccctccccctccaaaaagagaaacaacaaaaagcatgcaaggattaacatgctatctgcaaagtcaccaccctgcccacagtgtggcctttcacttcactgagtaatatattgtttgtaatacaacaatgtaatcagcttcttcattccagaacaaaattttgctttactatcatcatatacccagaagacccattaaactgttatttcaaaacagcagcctttccttagagataaattttacagctacccctagagtagttctgttggccaaagcctcttagcttgctagtgaaagaaacaaagtcaagccagcttaagcagaaaaggagaatttgttctgaggatacaaatatatagtaaggtaccaaaaaagaatttatcattggccaatttggataaggtgccctcctgtaaccctcctgtaatctaatcaacactgttagagagatgaggtgacagtataccaaatggcttttgatgaatctttgctgtgaactagaagggattaagttatgctcaactaatggtttgcaaatggctgaatggtagggcggatccacacgaaaaatttctaaataacaaaaccaatagcatgtatctcatttgtcctttttcctttccaaagagtcaacaattattgtatgagtcaattatctttataaaaactacattcattaacacaaatgcaagatctcaactatatatctttagttatatacatgtatacacatatatgtgtatgtatacatacattatcctcaaagacaactaatttagagcgttcctcatcccagtatctcagagaaatacaaagcagtttcttagatttggcatcattgagattttgggccaaccagatacttctctgttgggtggggaggaggctgttctgtgaactgtgggatgttcagcagcatccctggcctctacccagtagatgacagtagcactcctctcctccccacagtaacattcaaaaatatctccagatgttgccaaatgtccctggggtacaaaactcttccaattaagaaccactggtataaacaagtcagctgggagtggtggcacacacctgtggtcccagctatatgggagggtgaggcaggagaattgcttgagccaggagcttgagaccagcctagccagaatctctgcctagcctaggcagatctctacagaaaaatacaaaaatcagccatagtgttggtgtgcacctgtagtcccggctactcaggaggctgagacgtgaggatcaattgagcccaggaggtcgagactgcagtgagctatgatctccccactgcatcctgcaacagggacgctatctcaaatagttaattaattaatggaagaaagaaagaaatcctagctttgtaatttactctattactttgggcaattgccttatgtttccagaacttcaattttcttatgtacaaaatgggaataactttttgagctattttagagctatcgtaaggattagagcacataaccacaaaccacaaaatatgtcacggtgtacaggacagggcaggttctccgtaaatgacagtatttgcccatttattttcctgtaaatatgaaatatactaggatacttgatgtggttacactcaggtggaaactgacctatgagggagatagacagataggcacggtcttttttgtttgtttgtttgttttttgagacggagtctcgctctttcacccaggacggactgcagtggcacgatctcggctcactgcaaactctgcctccaagatgcaaatgattgtcgtgcctcagcctcccaagtagctggaattacaggtgtgcactaccatgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcttggctcaccgcaacctccacctcctgggttcaagcgattctcctgcctcagcctcccgagtagctgggattacaggtgcgtgccaccatgcctggctaattttgtatttttggtagagacagggtttcgccatgttggtcaggctgctcttgaacgcctgaccttgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggaggaaatccaattttacgagagggtgtagcctggtgaggcctggatgacctccggaggcaggggcttgtgcctgggctgaggcctaagggtcaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcaggacagggcatggtggggccaaaggaatcattacccaagacggggattttcagggaaacagcttagataaggccaggtgtacagtagctcccacctgtaatcccagcatttggtgaggctgaggtaggaggactgcttgagcctgggagttcgagaccagcctaggcaacatagtgagaccccatatccacaaaaaatttaaaaaaggagtttgtgttcctgtagtagcagacttgggaggttgaggtggcagtatcacttgagcccggaagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacgctgaagtgggaggatcgcttgagcccaggagttcaaggctgccgtgagctatgattgtgcctctgcagtccagcctgggcgacagagaaagaccctgtctcttaaaaaaaaaaaaaaaaaaatcttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgtggcaataaccactgcttccaagtctctatagaccaccccttgggtatatctaatgtaagtgatatttattttatttattttttgagtcagagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccgggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttcgttagtttcttcagattatcatccactgagggtggaaggggagtgagcagacacacttgggaggtgtcttgagattatcatccgctgagggtggagctgagggtggaaggggagtgagcagacacactcgggaggtgtcttgagattatcatccgctgagggtggagctgagggtggaaggggagtgagcagacactcggaggtgtcttgagattatcatccgctgagggtggaaggggatagagcagacactccgcaggtgtcttgaggctcagggagttatcagttatagaatgttgttgagttggaggaggtggctggtggcccatcctgttttttaaagtttcagctgtgaggtagggccagcagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcatatcacccttccactgagtactgccgacagctggggggtaaagaaaagtcactgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccattgtccacacatgttgcagcttctttttggagaatgttttccaggccctttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgttattacaaatacggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgatgcctgtaatcccagcactctgggagggcgaggtggatggatcacgaggtcaggagattgagaccatcctggctaatacagtgaaaccctgtctctactaaaaatacaaaaaattaggcgggcgtggtggcaggcacctgtaagcccagctactcgggaggctgaggcaggggaatcacttgaacctgggaggcggaggttgcagtgagccaagatcacgtcattgcactccagcctgggtgacacagcaagactccatctcagaaaaacaaaaacaaaaacaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttactgtgtttcacagggcagaaacagctgggcttataaacaggaatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtgctttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgattcaaagatcccccctgcaaccttcccacaaatgaaccaactgattctcacaagcaaagggagaatggacacctcccattgagggacaaaaaaaaaatcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgctggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgtcatgtcctgaaaataggtgacaactgcaaaccatccaccctggtgttgactgactttaacaaggttcagttcacagagattgagggcagaaaaaggaaatggcctcaaaagggtaagtttgctgtgttgccctcacaccacttgattcatggtcctgatcctaaggatctcacctgatacttggttttataggaaggatgtataaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccgtggcctttgtagggactgagcctgcaccgacgacctcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatgggcagcaaaatacaatgtaatatgaccaaaacatgaaagactgtgaaaatgaatctggaggtgacccaagcattgaattcaacaatccaggctgggtgcggtggctcacaccgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaatttaaaaaaaaaaaaaaaaggctgggtgtggtggctcacgcctctaatcccagcactttgggaggctgaggcgggtggattacctgaggtcagaagttcgagaccagcctggacaacatggtgaaaccccatctctagtaaaaatacaaaaattagctgggcgtggtggtgggcacctgtaatcccagctacttgggaggctgaggcaggagaattgcttgaacccaaaagacagtgagctgagattgtgccattgcactacagcctgggcaacacgagcaaagccccatctcaggaaaaaaaaaaaaagagagagagagacaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaaccttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagaaccataccttcctgtctacggcggttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggcggaggttgcagtgagcggagatcacaccactgcactccagcctgagcgacagaatgagactctgtcacacacacacacacacacacacacacacacaaaacacacaagaatgacgaggctggcatgttggctcactcccgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaagttgtgttgagctgagattgtgccattgcactccaacctgggcaacaaaattcaaactctgtctcaaaaaaaaaaaaaaaaaaataggccaggtgtggtagctcacgcctgtaatcctagcactttgggaggccgaggcgggtgaatcacaaggtcaagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaaggaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaactttacgcaaaacattctcactaatgactgaattcccaccaaatttccatattatcacagtatgcttttaatcttctcagatattaagtatttgttctcatcatagctaaaatgcaaagcaaatcccatctcagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatgggatttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacacaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaaaatttttttttttttttttttttgagacagagttctgctccactcagtcgcccaggctggagtgcagtggtgcaatctcggctcgctacaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtacaggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttctcatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacccaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaattttttttgttttttttttttttgagacagagttctgctccactcagtcgcccaggctggagtgcagtggtgcaatctcggctcgctgcaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtataggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaagaaaaaaaaaaaaaaattaccgaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaacaaaaaagtcatcaaaccagatgacacaaatcaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccgaaagagcagccacagcacccatctactcacacaggtggactgatggctgataaatcccagcaggagccaaaagagaagccaaaagagcagccaccgcacccgcatgtcctggtcctttcagggcgcccggaggtggccaggacagaggtggaggtggcttagggcaggggggagggaaggggacggggactgggcgggatctgagttggggagggggaggggaaggggaggggaaggggaggggaaggggggagtaagggaagggaaaggagaagggggctgttgggtacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaagaccaggtcctctctggaaccttcacaaacctgatttctggtccaccccaaccagctccctgtccctgcttctgggcgctccttccttcctgagctcccagggttcctcaaggtcacttttggtgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactggcctctcagggacgtccaaggaatctatgcatttcaagaaacaaagttcatcagcttctctcctaaggtgtttgcccacaatacccagagggcttggccgcatcatgtgtgatgggtggggagctccaagcaggtgggcaggacccaggggcctggtgaccaggacagacccccactgtccatcacctttcctggccctgtcctcagctaaacttcccacaggccttctgcccaatcacacagagtgtgcccaaactctctcaggcctctggcagctgaaaaccactgctttaaatccctttaccatttactatgacataaggttattgtaaacaggaaatattctattgatgctacaaatagaaagccaatgcctttaccataaatagaaaaacaaccctaagaaacaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtgtctaataaaatacaaaaattagccgggtgcggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaaccccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctaggggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctgctgcccggcaggtgtggggctcgggctcccagccacctgcaggacgacagcagtggtcagcgggcggcagctcagacctgctcaggacctggatgagaagccacctcctcagcagacaggacagagcccggtgccatctgacagaatgtcctagaatgctggatatatgggacatctgcaccgtccgtgatggcagcccctcgcgacgtgtgccactgaacacttgacagcagactggtgcagctaaggaacagagttttcaatttcatttttttttttcttagatggagtctcgctctgtcacccaggctggagtgcactggcgcaatctcagctcactgcaacctccacctcccgcgttcaggcgattgtcctggctcagcctcctgagtagctgggattacaggtgcctgccacgatgcccagctgattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgagcttttctttgtgggattttttttttttttttttggagatggagtcttgctccgttgcccaggctggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacggggtttcattgtgttggccaggctggtctcgaactcctgacctcaactgatctgcccgcctcggcctcccaaagtgttgggattacaggcgtgagccaccgtgcctggtcctttttaatgttttatatagatgtggtcttgctatgttgcccaggctggtctcaaactcctggactcagatccgcccacctcggcctcctgaagtgttgggattataggcgtgagccaccacacccggcccggccactgggaggtttctaagggactaactcggcctcttcacttgctatagacgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggctctgggcatggtgccgaggcccaggctccattcccagtactccccggtccccagccccagcccaccttgctccgggacatccagaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggcggccggtcccatatggagagccagatgtgcttgtcaaagaagccgcactgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcggccagcacctccttctccaccaggcccccgttggcctccgtctccaccgaaagccagtcattgaccaggaagaaggtgctgtgtgccgtctgcaggtccctgatgatgacgtgctgcaggaaccaggcagggctgagccctgcagaggcgcgggagggaggtcaggctcgcagggcgccccaacgcgggggcagaggggcagagcttggcagggtccgcacagacctttgtcgtgccacactcggatcttccacacgctacccaggctgtgcggggtggcgatccggaagatgtccaggctgttgcggtggaaggctctgtcgccatccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgaggttactgcaatttgtccaataaacagcaggacctcaaggacatgattaagttacatggaaagaactgtaacttgtgacatgcaaacatggctgcacacgcctcagtccacaccacaaccagtgacccgcactgcacacctgtccacgcctcagtcacgccacaaccagtgacccgcaccacacacccgtccctcagttcatgcatagactgcaaagcgtgaagctgtgtcacctcctctcccagtgacagacccaggtgacagtattttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaacacgccggcctaatttttttgtattttttagtagagacagggtttcaccgttagccaggatggtctcgatctcctgaccccgtgatttgcctgcctcggcctcccaaagtgctcggattacaggtgtgagccaccgcgcccggccgacagtttttaaaagtaggtaatcaaaagaaagaactgggaaatgaagataaaagcagcacggaaataaaaaatgggaacacggccaggtgtggtggctcacacctgtcatcccagcactctggcaggccgaggcaggcggatcacctgaggtcaggagttcgcctggctgacacggtgaaaaattaactgggtgtggtggcgtgcacctgtactcccagctactcaggagaatcgcttaaggggaatcgcttaaacccaggagctggaagttgctgtgagccaagatcacgccactgcactccagcctgggcaacagagcgagactccgtctccaaaaaaagaaaaacgaaaacaaaaagggaatgccagaagggcaattccaatgaaaggaaaatagaggtattgaagaaacagccacggggagggtgctggcgcctccgtctgagagacgagctatgcagtcaggatcgcgggtggatgcacggtctcccacagtggtagcgatgctcatgtcacttgtggggccacgctactgtgcagaatgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgtctgcgatgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcggccccggctggcatccaactggtccagcttgtgcaggatggcggccatgaccatgtaggtcaccaggcacacagcacatgtcagcatgacgatgtagtttacatccgctgtcggctcctgtgaggacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcacgaagaggctggcgccgaaggcggtgaggtggcgggtgaggcagacggcctggcggggcgaggtctcctccaggggcagcagcccctctgtccgccacaccacgtcctcctcgctgaagtactggcacagggacgtgtacaggcccacggacacctccagcgccgacaggcggaagtggctggagaggttcagacggtaactccccactgggtctctggtcctgggcagggaaggggcagtggacgtgagcccaggctccgccaggttggatatcggagtcccagagcccatacccggtccagtcccctcgctgcctgccgtccccacagggcctgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgtgctcattgggccggggctccgagtgcaggtagactgccaggtagggctcgggttcctcagacaggtagcggcctggggcagaacgcgcaggtcacacgcctgctgggaagctcaaccacccgggggacacccacgatggccctcctgagcccaccctctgccacgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgcctcacccgctgcacgcaccgtccagcagcgtatagttgagctgcagatgcagcacggccgcagggttgctgctgtccagggtgaccacagcaccgacggaggcctggggctggaccacaacggagttggcagagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttagccggggccctgctgaaagcctaggggatggagaagtggcagccaggccctggggcgccgccatagcacagcaggctccgcgggtccgagcgcttgccctgggccacgatctcctcgcccgccagtgtcaggggctcctcgttgagcacgcgggagcgcgtgaggatgcgcatgagggcagaggtcaggttgtaggcctgggacgccaccatccgcgatggtgactcggctcccagctctgagcgctgtggtgcccgcacgtctgagctggccaggtggatgaggtctcctgcagacagacgtgaggtcagtgcagagacagggaggcagagggagggtgggggcaggcaaaaagggggagccggagggtgggggctgggagaaagggggaacctgagggggcagagagcgaggtgcaggcagaagaaagggggaagctggagagagagtggtggaggggggagggggaaggggatggggatgaggacgaagatgagggggatgatggggagagggaggaaaaaggaaggaaaagggtagagaaaagagaaaggggagaagaggaggagcagggggataagggaggggaagggggataaggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaagggggaggggaggaagggggaggggaggggctaggggagggaggggctgggggaggagtggaggggctcagcgggaggaagtgaggggaaggtctaggggaggggaggaggagaagggctagcggaggggaggggagggggcaggggctaggggaggggggaggggcaaggggagggagggggaggggaggggttaggggagggaaggggcaggggaggggctaggggagggaagggggaggggaggggagagtggaaggcacagaacagcatcttcttagtccctccccacatctgggcccctctttacaccctgggtcccccgagaggcaccctgcgttcacacaggacagcagaaaggctgaggctactgaagcaggtcagagaccgaggaacgccatggcatgaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcaggcggcacagcaagctgtcagcagggcaggagaccggcaggaggccagcagatgcccacgactcccggggtgcagttacgtgctagatgctgtgtgatgtgggcattgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggataagccctccgcaaagctccaggcaggggtacaggtcttggtccccagcacgcatgcagcagatgtgaggtcccctgccaggctgcactcacctcgttcaggacggtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccatggcatcacgggagggctccgtgacgtcacagtcgggggatcccgctgctccccctaagcaggcctgtactcacccgtgcattcgaagtgcaccttggtggtgagggcgtgcacagcgcccagtgggaagaggcggcaagagccccccagcggcgggcggttgggggacagggggatggaggcgcagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaaggggtggtgagggggcgcaaccctctgccctgtcagccccacttctgcctgcaggccccgtcccctcggccatgggacccatccccagcccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctgacaggaggcaggcaatgctcactgagggcccctggggggatgcgtgtgggaacagacgtatgtgggggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccacgggctcagggtcaccaagcctcctggccggtccagagtggggagcgtgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacgtagaatttgcatcagaaacagagagggaagagcgcgcggcctccaccagcactaaaacacggaaaacagtagatgagcagggaggttgggctgtccaaggcaagtggccgaggggcgggcggcacccaccgtctggttggtggcctcctccttgcggccggccttccacacggtgaggctgaaggtgtactccacgccagccgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagcgcgggagaccccctccccatgctgggacggggcccaccaggcactgaggacgggccagccctggtggcaagctgggtgttctctgggctcatgggtgtggacgggtgaggggcatggaggacggccctgccacgcactgacctgtgtcgaagccacacaggcccactggaaactgagcggcgtctggtcgccatcctccaggttggggtcgtaggactcgctcccatccagcaccaggtcctgtgtgtctgaccacacgcggtatgagccaccctcagtgatgggcaccaggcgctcaggggccaccgtcacattggcctggatgctccgtgccagtggcgtgtccccaaatgacacgacaaacacaaagcagtagtgccccacaggcagcgccagccgcggcagcaccagctgaggccggctcacgtccacgccgggcagggccacacgcgccgggcaccccggctggtgggcccgagccagatgcagtgctcggctgtggctgggtgtggctccccgggcagccagttctggcagctctccaggctgaaggcctcgccctgcggcgctgggcccacctccacccgctgcacagtcgagaagccgatccacacgtctaggctcctgggggcgggtgtgggatgccagggggctcagggcactcctccatcctcccaccctcacagcagcccgctgggagccccatcactgtccccctttccagatggggaaactgaggctcagagcctggagagcagggcccaccaccccaggctcacagcagcacccacccacggggcctgtgggcaccggcagggatccccgcgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcacggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaatgagggtgtcaacggtcagtgtgggcccaagacgggggtaccaggctctgccccatctggatggccctggggaggaaggggagtgggcagcagacactcacctcgggccggctcctcgcccagggccacgatgctgtaggcagcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccaggggggcccctggggaggcagggaagacgtgctggaggagggtggggcccctacaggtgggggcaggaggcggcggggggccggagcagagggacaggcaggcgaaggaggcactagagggctgggccgccccacacaggcaccagccctgctccgagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacacccccatccgcccgccgcactcacaggctcccatgctgttcccttggcccggagcccccccccagagaggccttcctgagccctgcccagtgtctgcagggcccaggtcccacctggctgggaaggacagagctggccccacccaccggcactcaccacagccactgtccagcaaggggatgccaagcagaggctggccagccagggagtcaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacagaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaagaaggatcgcttgagccagggaggtcgaggctgcagtgagctatgactgtgccactgcagtccagcctgggcgacagagcaagacccggtctcgaaagaaaagaaagagaaagcaagaaaagaaagatggctgggcacggtggctcactcctgtaatcccagaactttgggaggccaaggtgggtggattatgagatcaagagatcgagaccatcctggccaacagggtgaaaccccatctctactaaaaatgcaaaaattaggtgggcgtggtggcgggagcctgttagtgccagccactctggaggctgaggcaggagaatcacgtgaacccgggaggcgaaggttgcagtgagccaagatcacgccactgcaatccagcctggtgacatagcgagactccatctcaaaaaaaaaaaaaaaaaaaaaaagaaaagaaagggaggagagagagaagaaaaggagaaggggaaagagccgggtgcaatggctcctgcctgtaatcccagcactttgggaggctgaggcgggcggatcacctgaggtcaggagttcaagaccagactgaccaacacggagacaccctgtctctaccaaaactacagaattagttgggcgtggtggcaagcacctgtaattccagctactcaggaggcttaggcaggagaatcacttgaacccgggaggcagaggttgcagtgagctgagatcgcgcccctgcactccagcaccccatcctgcaagagtgaagctccatctcaaaaaaaaaaaaaaaaaaaagaaaaaggacggagggcgagagggagggaggaaagaaagagaaaactccaaaaacaaaaaaagaaaaaccaggcaattaaaagaagcacaattggtcacagccatgggaaagacatcccatgtcagcagtcagtgaagaaaaggcaacagaaaccaaagggcggcagcatgtctctcttttcagagctgcccgagttacaaaccaggtcctggagctggtgatgtggaggtgagaagccagagagctggggcaaaccgagaactccacctcccctcggcctcaagcacctcgggggtcaccctgccgcccaccctgggcacccctcctggtcccacgcactcccagtagtgctcctggcacagggactgtggctccgcaggtctgcacaccacccccctgctccccaggaccccgagacctcacctcctgccacgggcctctacttccccaggtgtcaccctccccacgagtgacccagcaggtgcctctgcctagacttgctcttcccagcaatgaccacccggcagccaggcccaagccggggtggcctccatccctgagcacccgcccagcccctaccggcctccatccctgagcacccgcccagcccctgccagtccctgccaccctccatccctgagcacccgcccagcccctgccggcctccagccctgagcacccgcccagccctgccagcctccagccagccctgctcctcccaccggagctccgctcccgcagcagcctacccggcgcaggagagacgcacacacaggctgcctggtggggcccggggccagggcaagggcttgaaaagggaaccaacaaagaaggggaccagaggccaccccagctgaggggacagagcagccgaggccttctccgtgccaggaagcagccccagccacggacggtggagccgagccctcacctgggctgggcgcccagacagatgagacgctgggcactggctcccggagcttctcgttccatctgcggatggagggcacggttgggggtgcagttcccttcccccaggggctgtgggacactcagagagcctatgcctgtgccctgggctccgggaggggagaggatctgggggccaggcacacagggaacggcccctccggcagggccaccgcttcccccctaactgaaccctgcttctctgccgtcccctcctctacaccaaggtagggacacaggctgaggtgctccccactgcccataaggatgggtgggcccacagccacgctgctaggcatccacaccatccccgccgtggggtgggacagggtggcggctgggagaccagcaagaggccattcacgagacagggtgaggcagctggactcacacccgctgcccaagcaccatgcccgagggggaacactgtgctgtaaggaactgcagttagacctgaggagggacttttcagcggctgcggcggcagcagaaccaatgctttagggagaatgaggcaccaggacctgaggcgcagcagccctaaggggcgagaggtgctgcagaggccacggtgaacacaggcaggccccctggaagggacacagctgtgaaactgccccggggaggggcacaggcatggggagcagctcccacccaggccacgggagaaaggaaagaaggaaaagcctgaagatgtttggccacacctcattttctggaaaatccatcaagagtggctgctgctgggagctgacaagccagggcaggggtgggggcaggtcagccgaggaccccagagcccccccgctccccacccatcccactgtgaaccaggcctgggggtgccatggacacttcttccatgccagcaggcagccccgcctgtcaccggttctggccatgcactccctgcgtgccaggctccaggctggctccttctcccggccctcaccccagcccaaggcccacaaatgcagcaaggtcttggggaccccgctcggccgagctcccagggcccagggcagtggaatgaagctggggcccagacaggagccaggtgcagtcccccagcccccagggtgtggaagcgtctgccctgggtaggactcaggtgccccctgggtgtggaagcatctgccctgggcaggactcaggtgtgggcttcagggacagggaccagtacagggatccccgtggagtcctcaccccgcttgctcccgtacttttccacgtctgcatctgcttttgccatcgccgttctgggggaacgccaaggcctagccaggcagcctcgcgccagcccccccaccccgcccctcgggcttcctctgcacccgccaggtgacatcatcgccgctgtctgatgccctgcccccacgttctggttccctgcaaggatgggggacacagcagggcccaggcatctggcagcaggaccaccgagcggccctaagcccaggcaagagcacagagcagagtgcagggtcctctggggtcccaagcccttgctgccccacgcactcctcaccccagttcctgctataagctggaagggtgggagccaggtgcacagggacagcctgatgggtgcccgagggccaggatgtgctcccagggaagctgaagccaagcttgttgggagaagtacacccccatggggggcaggacggtgccccagccccgggacacaaggggcccccagcgccgagcgtccgatctggaaggcaggaggagttaggaccatcctagcgtgggacccagcgggctccttagcggctgctggggcaccactgggtggagaaggaagtcccaggtgtgtggccacagtacgggtcttcaccccttcccagcacccttgccaatcctggagcaggagcagcaacagcagagggtgtggccaggcctggaggctgcccctccacacccctgtcacaggtggggccacgtcccagggctgtgggcagcagggccagcctgccggcccgaggtatctgacacgtgtctcatgctgcagcgggtctgcccgccacccgggcgtgtgaaccccaggtcgggccccctcgccctggagcctcggcccctcaggggtgttcccagccaggcgctggctctcctgccctccccctgggctctgcccacagttggcgcgagggtgggtgaagcctgaggctggcagggcccgggaagtcttgtggctgggccttctgccccacaggcgctcctgggccgggggagccggggtcggggcgtgcaacagtgggactgagaacttccctgggtgtggggcagctcccggggccctcccaatccacaacagagggaatggccccagacaaaccagacctgcctcagagcctcacactcagagctgagtgccccaggcgcccatttcccagaccagatgctgagtggggtctgggggccggacggagcccccaaagaaacatctgcacattccagacgcgtgtggtcagcggcgggcgtgtgccaggcccggcacccctgcccgcgctggccgcctcactggaaactgggctggggggaccggctcggaggggccacctgcggagcttatgtaaccgctcctccctcggcaggggcaggacaggacgccagacccagggaggccccatgccccctgccaggccccgtcctctcctggaggagccggttcccctccgcccagcaagaggacccccaggcccgtccctcccgagagcaggcccagggtgaggaaatggggtgcagtgtgggcgctggagaggacaggggacaggcagcagtgccacccccactgtggccccttcctcgctgggccagccgagccatgacctcttctgtttccctctgcgctgtgctcctttctatttaaggagagtgaggcggcttccagggccggaaatgatcctgtttaaattaacaggctgcagtttgggacggtgctcatttgaaaaaaaacagtgcagccccgggctgggcagacggctgctggctccgcctaccacttccatggggagggccagggaggccggccacaaccctggccccacgaggggtgggggttgcagcctctgatagaggacgaggctgccaggccccaggcaacagagccctgcacgaggttctctgggtcccggacacggggtgtgagactagccggggagccccaggctcagcggcattctgtccttacagatccctcccatggctcaactgttcccaggatgagacgccgggggtgacatgggcagcctcaggtcctcccgggacccacaggcaggcacagggatggagactccggcctcggaggctgaacgagggagatgagaaaggggagtctgcgatgtccttgcctacacggatggaaaaacacagccagctcaaaaagggccgtttggagacaagcccacctgtgggtgtaggaaggagagcgcttcatacgtatgccacctgccgctggggtcggggccacccttccagttcaaggggagaatgagggccggctcctggtgcccctgcacacagctgacatggagccaggcgttgtgacccccttgcatccctctccactcccacccttcacagcctgggtgggcaggtgctgcactgaccttatgctcctgatgggcacagaggctcaagaggccctcctcctcccccaacaccatcccccaaacacctccccgggcagccagcagggtccagagtgtcaatggaggaagccaaggtaggaagagggtggtggggggggccaagcaaactggccatctgcgcccggctgtgcgggcacagcagtgccctggagagggcagcagcacagatccagcggggcagccggaatcccatcacccactcggctgtgggcacagccaatgatggcacgagccatcctgaggccagggccacgatgcacagtggacgggctcacaacccggagcccctgtactcccacagctgtgacgttccctgggcatgggcttgccccagcgctggcctcattcctgcctcaaccagaaggaagagctggcttccgcctctgcctgggcacaaagccctttccgaggtggcctgacagaagccagcctgtcttcagatcatggcgctgctaaggtcaggaacgccaggctgggccagggctgggccttgggagctgcagggagaaaaggacccagcccgcctcagccccagatgtagcccttctcctgccaccagtgcctgggcaccccggcccctaggcgaggacagctgccaagccatgaagagcgaggtgttctgggaaagggcgtgagctgcattttccagctgcgctcactctgcagggagactgtgacgcccccgccgctgtgcccgcagacgtgcccggcctcagccagctggagcgcaggcagcagagtgcaggccaggcccagacggcagcgggctgttttcattccagggtgcttggcgggctgggctgccgtggccactgcagagctccagaaaagaacacgtgtgtctccctccaaagtatgttcctcgctggaaagcagatcccaggcagggtctcccccacgagcagggggagaggcaccccaaggtgggggagcgagggcagtggcagaaccaccccataccctaggggacccagggaggggcttgcagatgcgggacccacatttggcagcggtgcccggccactgtcacgagatggtggccagcgcatcacccacacgtgggccaggatggcagaggagatccacagagatggctccagcaggaggccctcacagagatgccctggcctcagaagagccaacagaaagccgggaagggggacgtcgaggctcaagcttggcacaacctccccaaagctcccaaaggctcttggtgcccaccagcgacagcgcacaccgccaccacctaacagcaaggatgcagcagggtccgcacgtcagggcgggcactgagcggaactcaggcagtgccactcgccagcttacgtcaaaagaacaaaaggagtgaggacgatactcgcggctctgccaatacttcccagccccgcacgtctcacacacaccagaacgcgtcaaaaggcaccaatgggcaaacacccagaggtaggcacaagcaggagtaggccgggtcttgtgagcccctacagccacgcggccctgcgctgaaggcaccgaggctgggtgctgaggggtccataagagtccacccgcccaggctgcactggctcccgtcgtccagtgtccggtctaagcacaggcacagtgtctggctctcaccctcaggctgttacactctgctctgtggcagggcaggtctcacagtgcatggaggacaggggaatgggcccccggaacccctgagggaaccgacagagctactttaacaaggtatgattgttggggctgccagtggctgagccaggtcactgctacactgccctgcagggtgcatctaatcatggagcccactttacaggtgaggaaactgaggctgagagactggaccaaggtcacaccagaagtggaggcgctgggacgtgaacccaagtctgactccagggcgcaaattccctacatctgggttcccagcctccttcctgaaactgaacaggaaactacagggaagggacacagcagggatgagccagggagggagaggtgggaggggctggcagggagggagaggtgggaggggctggcagggagggagaggtgggaggggctggcagggagggagaggtgggaggggctggcagcacccaagcagctgcacctgggtgcagggcccctcagcccctcggggagtgcaagcacatcccagcccgactcggaagcgccactgccacctctgtctgtctataaaccagggcactagtgtgggccccaggcaccctgtgcggctgcaggggtctgccccagagcatgctgatgaaatcatcaccacggcttctcagagcctcaatttcctggtctgtaaaatgagaccaggagtggctgcaaccctgcagtgccgtgatgagctatggagagacaagaacacagagggctcagcgcagggcccggcgtggccaccgcggggagagggtgcggactcttcctagaccttttctttttgagacagagtttcactctgtctcccaggctggagtgcaatggtgcaatcttgcctcactgcaacctctgcctcccaggttcaagcgattctcctgcctcagcccccaaagtagctgagactacaggcatgcgccaccatgctcagcatttttttgtttttttgagacagagtctcgctctgttgaccaggctagagtgcagtggtgtgatattggctcactgcaacctccgcctcccgggttcaagtgattctcctgcctcagcctcctaattagctgggattacaggcgcccaccaccacacctcgctaatttttgtatttttagtagaacgggtttcaccatgttggtcaggctggtcacaaattcctgaccttgtgatccccccaccttggcctcccaaagtgctgagattacaggcgtgaaccaccgcgcccaccctgtttttttgttttgttttttttttaaagaccgtttcctagtcacccaggctggagtgcagtggcaccatcacagctaactgcagtctcaacctcatagactcagggaatcctcccccctcagcctcccaactagctgggactacaggcgccaccactaatatctatttattggtctcgctatgttgcccaggctggcctcaaactcctggcctcaagccatctgctctcctaaagtgctgggattacaggcgtgaggcaccgcgcccggctggacagtggttttgatttccgtttccctcatgactaatgaggccgaccatcttctcacacgctgttggccatctgtgcatcttctttggagaaatctctgttcagatcctgtgatttttttttttttttttttttttttttttttgagacagggtcttgctctgtgacccagcctggagtgcagtggtgtgatcacagctcactgcagccttgacctcctcggctcaagtgatgtcccacctcagtctcttgaatagctgggaccacagatgcacaccaccacgcccggccaatgttcttttattttttagagaccggggtctcaccctgttgcccaggctggtgtcaaactcctgggctcaagcgatccacccaccctggcctcccaaactgctgggattccaggcgtgagtgaccccttgtccatgtttaaacggggtccctgtctgttgttgaatcatagtgttccctgtatgatctggatgcaagccgatactgcatggatgacctgcaggtgctctctgtctccacagtcgcctctgcagtgggcgctcgggtgccccacattcccaactgctacagacacaaccaaagcctccccatcccttcccccacccctgccggcaatcgcgtacaggagtgagcgtgtgacttcttgtccacatttttgtccacaagtttggcgagtttgcatccgtgtctaataaagaaactaccgtttctcacgcaggcacgttctgaacgcccgagtgcgggagccacgtaagacccggctcagggaccccgggtgaggccagctgcacatgcaggatgcaggtcctcaccactgcctccgctcggctgccagggctcttcctagaagacacgggcctctcctaggctctcctgactgaggccctacccctgcccccgagtcaccttgccccttggggactctctctgggcagctccctgtgggagctttgaaacctggcttcaatgtcacctgcactgggggtccttccaggccagccccctccccatcatccatctctgtccttggagaatcatctgcgtgtttgttgaacgcgggctccagtgataacggagccctcgagggtggccctccttctgctgagggctcatggaggccttggtgacaatccctagtccttgctctcaggatccagggaccagaaatgggagccaggggcccctccgtggcctggccagccccccaaggaagctgtgtctgtggcagttgcgctctaaggcatcaggcctaggggtcgctccagaatgactgtcttccccgacgccaatcccaggcaggggccccggggtctgcgcctgctgtccctacactctcccacactctcctgtcattcagggatgcaggtgggaaagggcaaggccctgggtgctcctatattttacatcagtgaaccaagcacctaccaagtccctcgatgtgcccagtcctggaccccagcatttgcgagacagcagcagacccaggtgacccccagccagggtgagtggcaaccagcaccagaagtggcctttagagcagggggccctgagctgatgacatctacacctaggtcactgccagccaggacaacctctgggacaatgggatgtcggctccaacgaccaatttacaagaaacacaaaggacacactcacagcaccacggaggagacaccatggaggtggcacccccaagacacagcgagaaatccaggctgcaggagccagtttcttcaacaaattgcacaaggaaaaagagaggaagggaagctcctagacatcatcggacatttaaaagacaggcggtggctcaagcctgtaatcccagcactttgggaggctgaggcgggtggatcacgaggtcaggagatccagaccatcctggctaacacggtgaaaccccgtctctactaaaaatacaaaaaattagctgggcatggtggcgggcaccagtccaggctactcaggaggctgaggcaggagaatggcgtgaacccaggcggcggagcttgcagtgagccgagatggcactgctgcactccagcctgggcaacagagtgagactccatctcaaataacaataaataaataaataaataaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagccgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcgcttgcaccagggagtcggaggttgcggcgagctgagatcatgccactgcactgcggcctggagacaagagcaagactccgtctcaaaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcagtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatagaaaattagccaggaatggtggtgcacgcctgtaatcccagctactcgggaggctgaggcaggaaaagcgcttgaacccaggaggcggaggttgccatgagccgagatcgtgccgttgcactccagccttggcaacaagagtgaactctgtctcaaaaaaaaaaaaaaaaaaaaaaacacatgggtcaggaggggaagggtcggggcagggagggcagggcaggctctggggtggggggtctgtgagtcagccacagctctgcccacgtctccccacggagcttcgagccacgcagagcagcacgttttgcagtacgccatcttttccaaaagccaccacctctcggcagcatcattaacccaaggcaggctgtggcctcagaagccccggctgtcctccacctggaactggacacagctgtccctgctgagcttcagcagccagggagccacaagtggagaggcacctgcgtgagctccccaggaaggctactggtgacacccagacagcaacgctcctggacccttaaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggctccgctgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccacccaatgtttagcaagcctggggatgtgccacgtcccccagggatccagcacgcacccaaggagacactgtcccggcgaggagcctggagcctgggaaatacaaggcatcagactggtcccaagactctccccagcgctggggacaactgtctgcttatcttagtcccctgcgcccttttcaatccaaccctgggtcctgggcacctcatagttccaaatccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcatggtctttgctcacaccgttcaccccccttcttctggacccacctcatcgccccttcctaagcatcagcccaattcttgcacatccatcaaatccttgtccagacacctcctggaactcttccctgcagccccctacaaccatccccacctctccgggtaccccgcagccccaggccgcatcccaattcctctccaattagcgactgtttgtcctcccagctgagcgggcctccgggccccgcccccgctggcgtctgcacagcccccgggtgggacgtctgtctccagacccggggtttttcggctcccccgggccgtgccaaccgcggctccaggcgttccttatttagcagggccgctgtgcccgcgccggagcctcgccctgggagcgtcctggcccgcgtcctgcttcccgtcccgggccagggaacgcgcccacacccgcccgtcccgcggcctctcccgggtgccgctgggcccgctactcacagcgctgtggcgtccgcggggatgcgcagcgcgggaccgagcgtccgcagcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcagacggcatggcgggcgcggggctggatggggctgcggccgcgacctgctgctgagcgacgcccgctcgaggctcggggccaggccgctccgggagcttggccgcccgctcggacgctggcgctgcagtgcgagccccgccgcggctcctcctcctccccgcgccgcgcggggcggacggggcgcggtgggggcggggcgggtgcaggctccgcccccttcgccacagcgcgaccaggccagcgatgagggactggcatccggaggcttcaccctccgctccacagggtcggcagcagagcggggcctccggaagctccgccccacgcgttcccggggcgcatgcgacgtggggcggagcgtctggaagctccgcccgtcgcactggagagtcggccgaggcgcacgaggtatttttcacgctccgccccactgcaggctaaagtgcgtgggcgggaagcggtgggcagggtgccatctggctccgcccttctcctgtggtgtgggccaggcggcgggttcctcctcctgcagcagccacaggctccaccctgatccttctcccgcggcatggatccttctcccgcggcgtggatccttctcccgcaatctccgtgcgcgtccccagtcagtacccgcagcctcccgacgcacccgctggctccaagcctccctaccccaggtttcctggctaagagagagacagaaggagagagggggaagagagagaacaggcaatgggaggttgatggtgagagcttattgaaagacaagagggaggaaacccacatcctccattccccatccattcatttattgccttatttattccattgaatcttcacagctctagaaaaagtgtgctacaattattccctttattaaatgaggtcactgaggcacagtttaagaaatttgccagcagggcacagtgggtcactccggtaatcccagaactttgagagggggaggaaggtggatcccttgagcccaggagttggagaccagcctggccaacatggcgagaccccgtttctacaaaaattagccaaaattagccaaactggctcacacttgtagtcccaggtactcgagaggctgaggccggaggagcgtgtgagcccaggaggcagtggctgcgctgagccgtgattgtgccactgcactccagcctgggcaacagagtaagaccctgtctcgaaaaaaaaaaaatggaaaaaagaaaaaaagaactggctgggagtggtggctcatgcctgtaatcccagcactttgggaggccgaggtgggtggatcacctgaggtcaggagtttgagaccaacctgaccaacaaggtgaaatcccatttctactaaaaatacaaaaattagccaggcgtggtggcaggtgcctgtagtcccagctactagggaggctgagacaggagaatagcttgaacctgggaggcagaggttgcagtgagccgagattgcaccactgcactccagactgggcaatacagtgagactccgtctcaaaaacaaaaaaaatcctaccacatgtgctccaccaagctctgtctccaaggtggccttggaagccacatggggaaggtggcagagactctaggagcctgagcagagacccagatgattatgaaaaatgcagacctacccatccttattcacctgggaccaccgtgaactatatcataagaaataaacccctattgtacatacatgcaccattccagttgggtctatttgttacagcagtttagccaaccctaatccacatatacagtgtcaacagtggctgagatgacatgttgcacagacatgagagtcagaaagacctgagttcaagtcccagtgatgacatttactatctgtgtgaccttgaaaagctgcctaactactctcagaccgtttcctcatcagtttgttttgagaatcaaatgagaaaattactaaaaagcccttagcactgcatctaagatggggaagagacagtcaatgaattcaagtttcctgaagcccagttgcatccctgccctgtcctgggctctgagagacagttgccgaagctagtgttaaagtgaactaaatatggcctgagtgggacttcgtacttctatagttgagtccttgtggacaaattgcaacctagcttaataggtagacaagattgaaaacctaacttaggagtatgcgtctgtaacaatagctgagtcttggccaatcccagaggccgtagttcaaccgctcatacgctgctgagtgttcaaactgtactcaaataaggcaaacgccaacttgtaacaatccagccattctgtacttcacttctgatttctgtacatcatttcccttcttttgtccataaatcttcttccaccacgtggctgcgctggagtctctatgaatctgctgtgattctggggtctgcccaattcgcaaatcattcattgctcaattaaactactttaaatttaattcagctgagattttcttttatcactaatttgagctggttttctaatgtttgcaaatgggagggctgactaatataacactgctccaaatattaacgtctttctcccaacccatcacccaggcagaagtggtccagcctggggaaccctaggaggaggctagctctcctctaggaaggcttaggatgcagccagtgggcagtaactggctcactgtcccctgcaactgaaatcagaactggttccagaaaccaagttgacccccaaccagtctttcccaaaatatggctctatgcccatctctggtcaggctgggctgttttcctggacagagaagtctcagacaagcaggcagtggttagtgggctgtgcccaggctgagaacatttcccagagcagatggcatctctggcagtcccttaaagccagcagaggccaagtcatgtccaagaggccaaaagacccaatatggtggagacagtctacagtccccatgaataagggatgccgatgccttccctatgtaccaggtagtcactgcctgaggggcccagagcagcaggagggcagagccagcctgggcaggggcactgggccggaagtggggctcacatcctcagcgcgcacacacactctcacacacacacacacacacacacacacgaatgcacgcatgcacacacaaatgcacgcacgcacaggtgcattcaaacatcacatacacgtgtacattccttgcaaagtcaacttctgctgatagcacaacaaacaatggggccacagtgtggcatggaggaaaccctggagtctgatctcatttttttttttttttgcatctgtcaggagataaagatatttgataaaaatccttgagtcacatccccaccaggtccctgcctacctgtagaccccatcaagccagctccatggcccctcagataccgcctcactgggtccccagggattgacctcagtcctggaaatgcagaaatatctgtatctgtcacagctgagactggcggccttccgccggctttcctggaggcagaggtggagacagggacttgggtggatgtggtttttgtttttgttttgaaaggggctttcaggagaagggaggtgaggactacaggatgcagaaggggacagagcagagtgagaatgtggtcccttaaagtcccgccttgacctatcccacgagcagcagagagcacgccacaggatcgtccccaccgtggggcagggaccagccattcacgttgctgtatcagttagtcactgggccattactgggcatggcatcccatcccaggcaacgtggctcccatctgagggtgattctctagagaaggacagctgtgagctctcagcaggtgaggctccaaaagcagctatgccagtctagacctcaggggaagggggaattcatctctaggcagggatgattttcataacattgaactcttgacatgcaggagcaccgaccaatcagaacagacacggtgaccaaacaggcacagccacaccagtggataccagcggaatgtccacgctgcctctgcgaagggacagtcccatgagccaagccctagaccagctgttctgggagcactgcatcattgcactgaattctcacaaccgccccataatgctgggaccatccccattttcctgcccaacagcctccgtctcatagacactaggcggctctcccagggtcacacggtccagtcaataacgggcagaactcgcactccgatctgtctggctccaaagctgctaaaaattttctacttggcctcactggcttgacaaagattaaaaaagaaggcaagtccttctttccaagagatgctgaggtccctcggcgacgctaggtcatgattttatcatgttcagagggcaatgaaagggacagaaaacaagcgatgtgtgatctcctgtcatgtcaagagacgctgatttcaaagaaacgtacgtttcgcagaatcaatacgctgtggggcctcagaaagctgaggcagacacacggccccgacccgtgcacgtgggagccctgttacaagagacggcagaaattaaactgaatcacctggagcaagtacattgtaaatgttcaatattaatgacccacctcggccccaaagaagagagcgttgggctttgtccagctgtgtgctctgttgttaaaagaccaccttgtggccaggcacggtggctcgcacctgtaatcccagcgctttgggaggccaaagcaggtggatcacctgcggtcaggagttcgagaccagcctggccaacatagtgaaaccccgttgctactaaaaatacaaaaatttgctggatgtggtggctggcgcctgtaatcctagctactcgggaggttgaggcaggagaatcgcttgaacctgggaggcggaggttgcagtgagccaagatcacgccattgcactccagcctgggcgacaagagtgaaactccgtctcaaaaacaaacaaacaaacaaacaacaacagaaaacaatttgtgccttaatgggcattcctttcccttcttgctaagggatgagatgatggcagaacttgtggccactgtcctggaggttgacaagctttttctgtaaagtgctagataataaatattttgtgggccacacgatctctggtgcaactacacaacgctgccattgtcatgcaaatgtagccatagatgatgataaatgaatgggtgtgactgtgttccaataaaactttatttataaaacagacagcaggccagagttgggcaatgggcagtagtttgccccacactccccgcccatccgtcctattccttggcttttttgggtacatcaaggagtgcaatctggatgctgggctattttatggccactgggcataaccttaacctgggccttttgtctgttaacctgggtcagtggctacggtgaaggtcgggcaaccaaggtttagatggctcagtacacattcacgcccacaaaccaaaccaggaaaaagatgtgctaagttgagcatatgacactgttggtactcaaatggtttgtttttttttttaaataaatgtttaagtaaattttttattttagaacagttttagaaaaatggtgaaagcagtacagagagtttccatgtaccccatagcttgatgcattatgaactaaagtccatactttttttgggggggtggggacagggtcttgctcgtcacctaggctggagtgtggtggtgtgatcatagttcatggcagcctcaaccctcgacctcccctggctcaagtgatcctccatctcagcctcccaagtagctggaaatacaggtgcctgccaccatccccagagaatttgtttttgtttgtttgtttgtttgttgtttgtttgttgagacagggtctcactctcattgcccatgctggtatacagtggcacaatcacgggtcacttgcagccttgacttcccggactcaagtgatcctcccatctcagcctcccgagtagctaggactacaggtgcacaccacaagcctggctaattttttgtattttttgtagagatggggtttcgccatgtcgcccaggctggtcttgaactcctgggctcaacccatccgccggcctcggccccacaaagtgctagggttacaggcgcgagccaccgtgcctggccacctgaagtccatagttgattctgattgccttagtttttgcttaatgtcctttttctgttccaggataccacatggagcattttgaggagtgctggtcaggtattttgtagaatgttcctcaactgggatttggcagatgcttttctcatccttagtcttggcttgtgtgtgttttgaggagaaggaccacagagcttaagaatcattctcagcactctgtatcaggcacgcattctctcaagatgacttgccgctattgatgttgactttgatcacctggctgaggtagtgtctgtccgtgttctccactgtaaagttactctctcctctcttttcacactgtactctttggaagagagtcactatgcacagcccacacttaggatgtgggaagtccgctccacctccttgacgatggaatagctatataaattacctggggccgggcacggcggctcacacctgtcatcccagcacttgaatgggaggccgaggagggtgatcgcttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccaacctgggcaacagagcaagaccctgtgtaaaaaaaaaaattaaataaaaataaataaataaataatctggaattcttctgcctgggagatttgtctcttctctcttatctgatcatttatagcagtatggaatcatggtatttattctttgaattctaatctgttacgtatttatgacagtatcagtaaaagcctcccttgaaatttaccaatggcatgaacatttcagatgagtctgccatctttggtgctcctgggacacgagagagacctgtcttgcttgctgatcacaaaggtggctttttctgtggccaaagctaaggctgtagggtctggtaagaagaaaagatggtcatgttcctcgtcaagtttccagttggctactggagagatcagtcaaagagtacaacaatcaatcattcgttcattcaaaacttaagtgcctcctatatgccaggtcctgtgctatggaagcaggattttgattagaccttttaaaatgggaagcaacaagaaaagggagaaagtcttatctttgatttcagcctaaccaagggaggcatcactgtttccttcttcttttttctttttcagaacgacgtcctatattactccctgacaggggtgaggagtgtttcctacagttcacaggaaagattatgcatccatgattccagtccctaggcttggaagagaggtctgcataattgagatacagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaacaaacaaacaagtaactgagttctcttactagaaaataattgtaaagtaacgtacaagtttgatattttctacacatggagttttaaatatgaagcagatatgaaggtatagtaaatagatcaaattatttaaagcaacatgtttaaactttcaaataaaacttaaacagaatcagtagtgttcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctatggagagagaatttcagaacggtatcaatggcctccaaaatatccctgccatttgactatattctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacagttttgaaatacacattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggatgagtatgttaattgacctgatttaattattccacaatgtatgcacatatcataacatcccattgtaccccataaatatatgtacttatttgccgattgaaaatgtttttaaatataagatgcagaagaatgtgtgctatcttttaaattttatggcatatggatgtattaactttttaaaaatttaaaagcaatatgtcaaactatttatagagtagaatccaatgatctatgtgggaataagaaagtgtgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatatggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgtctttagaatagcttggtcctgttcactcatattttttcttttctttttttttttcttagagatggggtcttactctgtcacccagactggggtccagaggcatgatcatagctcactgcagccttgaaccctgggctgcagcaatctttttaccccagccttccaagtagctgggactacagacatgtgctaccatgcccagctaattttttttttttttttttttttggtctacagacagggtctcaccatatcgcccaggctggtcttgaactcctagcctcaagcaatactcccatgtcagcctcccaaagtgttgtgataagaggcatgagccaatgggcctagactcacttacatcttgacttttttcctcttgactcagctctctacctggggcaccatattggggcattctaaatatcaggccctaggtagtggctcctagaaggccatgttcactgtagctttttttttttaagcagttctagaagaaaagagccaaaggtgcctcttccccagcagaggcaacagtatgcattgcataccaactgagtcacctgctcatttctgaaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacatgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaacttttttattaatcagttttataattgacaaataaaaattgtgtatattgtatttattgtgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagattgatcaataaaacctactgtaaacttaccaagatcgtgtggtaccaaaacacactccacaggattacgagattgggagctctagggaagcccgataaaatccaattttaaaatagcacaaaaattaactaactattgggtactaagcttagtatctggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctgattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcccaccatgtgcgaggtgccatgctccgtgctcagaacacagctgtgaaccaggtggacatggtgcccttcctagaaacaaaatctaggctgcaagaatggtggctttaactcacttcaagaaatgcattcaccaagcaccttctctgtgccagcttttgcaggggatgaggcgatgtcacagatatatcagacacagcactgctctgaaatgctcatggaataatagaggagacaggctagaaaatgaggtccattatttgtgttttaaaattaggccaggcacactgttcacaatagcaaagacttggaaccaacccaatacccatcaatgacagactggataaagaaaatgtggcacatatacaccacagaatactatgtagccataaaaaaggattagttcatgtcctttgcagggacatggatgaagctggaaaccatcattctcagcaaactatcacaaggacagaaaactagacattgcatgttttcactcataagtgggaattgaacaataagaacacatggacacagggaggggaacatcacatactggggcctgtcagggcgtggggggctaggggagggatagcattatgagaaatatctaatgtagatgatgggttgatgggtgcagcaaaccaccatggcacgtgtacacctatgttacaaacctgcacattctgcacatgtacaccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaactcaggaggcggaggttgtgatgagttgagatgacaccattgcactccagcctgggcaacaaaagcaaaactctgcctcaaaaaaaaaaaattaaattaaaaaaactaataaaataaaataaataaataaataataaaataaaatcaggccagctgcagtggaacactcacgtctttaatccctttgcactgtaacccctaagtactttggtaagccaaggcaggaggaccacatgaggtcagaagttcaagaccagcctcggcaacatagaagtttaatttaaaaaaaaaattaaatttaaaaatagccaggtacagtggtgcacacctgtagccccagctactcagggctgaggcaggaggatcacttgagcccaggagtttgaggctgcagtgacctatgattggaacccgggagtttgaggctgcagtgactgattatcatgccactgcactccaacctgggtgacacagcgagatcctgtctctaagtaataatgatgatgataaattaaaaaataataatttttattatgttgttgttactaacaaaatttattgagcccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgaccgggctgtgactcaagccaagagctgtttgtctccaagactcttaaagactcttttttaaaaccagcatgctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcggtcatttaatgacaaagggtaactggacaacctaccaccagcaatttatttttagaccaagttaagtcatacttctatgcatgacctcattcccatgactctcctgccctgcccccagttactgtcctcagctctatgatgcaaatattctgcagacgtgtctctgccctgcaagattccctagacagctttaccttgactacagatatgtcaatgtccgccaccatagaaaggtctttctgcagaccgaactgaactgatgctagcttgttccatcaggaccccttctttcactgtgcaaactgtcccccaagctcctgtgctccaatcagacaatcagaactttccattcatttcagcaaagttctattgagcttccactctgggttgggtagtagtctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggccatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacgcctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgggcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttaagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttctttcatagtaacaaaaagaaaatgttgaccacctgtattagtccattttcacactgctataaagagctgcctgagactgggtgatttattaaaaaaaagagatttaattggcccacagttctgcatggctggggagttctcagggaatttacaatcatggccgaaggggaaacaggcatgtcttacatggcagcaggcaagagaggagagcaggggaaacagccacttataaaaccatcggctttcttgaaaactcactcactatcacaagaacagcatggaggaaagagcccccatgatccagtcacctcccaccaggtccttcccttgacatgcggagattacagttagagatgagatttgggtggggacacagagtcaaaccttatcaccaccctatttacaattgggactccaaccctctcaacatgccctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattaaataaatagtctgaatgactgaatggccaaacctggaggtatctcttcccaacccctcttcctcttatttttttaagcaaaaaacaataggctattttttcatgccaagaaaactgagcctccatgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcttaagcacatgggacacaaaccttgcattaaatcaaagacttaatccaagttaagccaccctggatgaggagctagagctggagacatgtaattaacaccagccagtcagcaccaactgcttcagctgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacctgtgctttttcattcaatgttccctcaccaatcatctagaacagtatgtagcatatatcaggcactcagtacctaactgctgagttaatttgttggctagttatctgattgattgactgattgattgggtggttaattaaatggttaattaatttacctcctgaggctgggcccccatatggccacctagctaagaaacaccatcaaaccgggggtgggtattttggttacgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcatctaccctccagtgaactagaacttttgtcagctcctcaaagtcaccaggttcttgccacatatgacgtctcttcctagaacagtcctctccatcatgccatagtcttcaactctggccagcgcctgctccccaggtgtcccctgtctgcactcaccacactcttcttgcagtgaatcaccagactgtgggttccacgaagcgagagcccttgccttcttcttccccatggtatcccagtgtctagggcattgccagactcatgcttgaatatttgctaatttggataggagttatcatcttatttcacagatggaagttatgaactttttacacacctaatgtacgggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcactcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacgtaatggctatgtgaccttaaacaagttatctcagctctctaaatctttttctcatttataaaatgacaatcatggtaaatttataattcattcaacaccgttctcaaggctaggaatatggcagtaaacaacagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcgcttgaacccgggaggcagaggttgcagtgagctgagatcgcgccattgcacttcagcctgggcaacaagagcaaaactctgtctcaaaaaaaaaagaagaagaaggccagtggtgcctctggcatccccaaaagcaagcctccaataccacaaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcccctagcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccaatgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggacggtgctactggtatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctgatggagggtatgctggtgtgacctgttactatttagtcaaaggaagattcacagacccaaggaccagcagttctataagaaagtcttacaaagctccttaggaagacacatacagaaataatcattgcaaggttatttgtggaaggtggaggtaacgaggttgtctatcattggggaactaggcagataaaagtggatgagcaaataccgtggggtattagaagtgaccttttttttttaatttttctttttcttcttttttttttttttgagacggcgtttcactccagcccaggctggagtgcagtggcatgatttcagctcactgcaacctccatctcctgggttcaagtgattctcctgcttcagcctgctgaatagctggaattacaggtgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatggaccttacagctttaatgagagtgaggagggggagttaaaaaaaaaaaaacaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcctcctttcatgaagttcaaaaccaggcaaaactaatcaacagtgttagaggtcattacactaatgtcctttggaaaggatagactttttttttttttttttttttttgagacggagtctcgctctgtcgcccaggctggagtgcaatggcgtgatctcggctcactgcaagctccgcctcccaggttcacaccattctcctgcctcagcctcccgagtagctgggactacaggtgcccgccaccacgcccggctggaaaggatagactttaaggattgacagggagactcctgcagggtcagaaatattctatatgttcatctaggtggtgattacacaagatctatacgtatgtaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggccgttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcgggaagctgaggcaggagaattgcttgaacttcggaggtggaggttgcagtgagccaagatggtgccactgagccgaatccatcaaaagaaaagaaaaggagaaacaaaagaaaagaaaaggaaagagaaaaaagaaaaagaaaagaaaaggaagggaagggaagggaaagaaaaggaaaaggaaaaggaaagagagggagggaggaaggaaggaaggaaggaaggaaggaaaacctatacacagatacacaaatttatagacactctattcatagttagcaaaacctggagaaaatctaaatagcctccaaagaggaagtggataaacaaacatccacaccatggaatactatttggcaattaaacaacaaacaaactcctgatacataataaccagaatgaatctcacaggcattatcctgagtgaaataagtcagcctcaaaaggttattatcttagtccattcaggttgctatataccaaaataccataaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcatgggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcaactttactatatgtacttaaagtataaaataaatgagatattgattcagagtcatattccacaattaataactatattaggaataaacaaatacgcgcacacaatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcggcaacacctcttcagtgtttctgcctagagaagcccacgtttaggctcaaagtttgggtgttttattgagagctggtcacataagcacaaaaactagaaacaactattgaaattccaggctcctggaaaggaagcaggtattctgggcgcgaagcaggtattctgggagctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagacggaagattctcaccctactgcaatgactctcccagcccactgccaccaaagtttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccatagaaactctctgatattaattgatctgctcctagttttcagttattctattttttaaaacatgcgacagtgttaactaggcaggctcactagcatgatggatggatgagtgagtgggtgggtaggttgatggatgaatggatggacagatgaacaaatggacagatggatggatggatggatggatggatggatggatggatggatggatggatggatggacagatggacggacagatgaatggatggatggatgggtgggtggatggatggatggatggaaaaatggatggatgtatagatggagatagatatagacagaactagatacagacaaatagagacatcgttaaagagagagaggtaattatttatttttgcaacaagtatttattatctactttaggtcaggcactgctccagcttataactgtttgttataacagtaaccaaaacaaacaaacatccactaccttcccggagcttagagagagactataaaaattaaaaataatatatagaattatagatggtgttaagtgctatggggagagaaacatcaagtaaaggggcttgggaccggctggaaagagttccagttcttaaagaatagggtcaggaaaggactcaccagaaaagtgacttttgaatggagacctaaaacagatgagagtgttcaggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccaccccttatgttataataatgtggtaacacaaaaaggtgggatggcatgtcacatattgactcggaagtaggcaaaaacgtgagaccaacttgggcttagatacacatacctaggaatatactaggtgaagtcaaagacagcaggagattgatattctacataaatatggaaatgcactttatgagttcttgagaatctctggggatttttcataggtctcacccatcactggtcatgtaaatatgtcatttttagcaaaatcacattctcttcacttctatctgttctgtattgctgcaaggactgctttttgaactagggtatgacaatgatccgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagcctacaccacaacaggccagaaacgtctaccttatccctcttgaaatgctaccctgagactgacatatggggagtctgggctagactccttgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagtagacaggtgaagcaattagtagtggaaactatccattcattaaacaagtacttatggagctcctactctatgcacacacagcctagtggctcacaataagcaacctttacagccactgcttgatgaaatatctccagacaaaagtattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagattattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggtttcatttgtgcattctcagacttgtgggaagatacttcaccagccccagccttagaaatgagagtaacagagctgtacaatctctgaggtgttatgtattcttaaggatacacttactggcagggaggaaatgctctaagccatttacatacattaccgacatcttctcttttaaccctccagggatcaggcatctccacggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtacatccaactgacagatgagtttagaagctatctagtccagacaagcttgaactcagctagtccagcctttcatgcacctcacctatttagtgacagggaagtcattacttctccaagcaacttacattacgttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacaatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggggtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctccaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaccctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccattgtcaatctttacattagggtagatttttgaaacttcaggtccctacaatctagattctgatttaattagtctagggtgggaccctggcctttagtatttttttaaagctgcagccctcagtggtgactccaacgtgtagccagaattggaaaccactctaatttgtattttattttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtgtatgagaaaaagagacagagacaagcagagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagccatacagacacacgagtgtgggcaatcattgttttatagaaatgggatcatattctaccaaccgttcccatgtattcaacaattccttgttgtaagccctccaagttgatttctcaaagaactaaaaatggaactttcactggacccagcaatcccatcgttgatatgtacccaaaggaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaagaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctctagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaaccttgtcttaaccacctttgtattccctgcagcgccttatacaaggcaggtgcttgatacaggttgaatgaagattatgtttaccaggttccaggtaagtggaaggaaattaaaagacagcccagctggaaacagtgggcaggcattacaggcaggcccagctttctaacagctatcataaaactggctgctcgctggagctgtgaatttcccatcgctggttagagaaattctttaaaagggagattcttttaaaaatggctgtcctagatgatgtctaagctcatctaattttcactaggttactacaatggagaatggttgatgagtaagcaaagacagcagaaacccactacacagtgaaataggaatagatgtgtgttattgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttttagagataggggtctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttaccttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattaccaatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcatcttctctgttaatgcccttatacaatcccctcaccatgagtgtgccatgtttctaaatccaaaagtgatgagtgtcacttccatgattgggatagaagagattgacttccatcttgccaccagactctctagattgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcacatccatattcctggcccacaactataagataataaatgtgggtcagtcaagctgcttaagtcatggggtcacctggtatgtagcaacagatcccaacataagacaatgtgtaatatttctataattagaaaatattccatcctagatatctcctcctgaaagccattcctgagctcccagaccagggtgtttttgtcacctctgtcatggtcttcatcatcctgaatttaataattaatatgccctgcctccccatctttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctgcagatgccaaatcaagggtaagggaggccttcaatattcagcaaaatctctactccatgcatcccccacatcattttctaagcagtttcttcctttccatcaccagggtgcttatcaattgtacattgacaattcctcccatctgttcaattcatctgttggatggtcactctctgccacttcagagcaatggggagttcactctgcctttcatacccctctgggaagcccaggaaaattatctctgattaatgtcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaatagcttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgcagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaggaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattcaaggccacctccaaaaggtaatcccgaactaagctgtccacctcccatgctaagtcattctttatcttgttcctttattgtattttttccataacacatcaccattttaaattaacttagttattgcctgcctccccatgaatatataagcttcatgaaagcaaagtgtgttcctgacttactcactattgtgaaaccaacatgctagcacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcatgcattctccatcattcctagacactgtgtgggaagacaggagattatagcttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagccactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatcggattagtgactttataagagatcccagagagatctttgtccctcctatcaggtcagattatagtgaaaagtcatccatgtaagaaccaggaagcaggtcctcagcagacactgaatctgtagataccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagagtcataatgttctttatctacatgacactttccatctttaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacatctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgactttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccattctgatttcaaattctccatcacttccctgctgtgaaggctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactagttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttaccaaacatcagttatctctatttaaggcattcccctacctccacagaaagaatgaatcattttaagcagtagtttaagcttttactctatccaaacaaaattggcgaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactggtcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaaacgataattactttggctatggaactccaggctattatctggggtgacattttccctcaggttggaatccagatatgtgagacaattaacatttcataaaaataacttttgaagcaatgtttgtccacctttctgtatctcagttgtctcctctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcacttatcttccaggctgccccctttgagcatcgcttgtaaagactcccactccaaagtggacccttgctgtggtttccatagctctcaggacttccctttgcattgtgtaactcactttggatcactcgtaagatggctgccaccctaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggtaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggatacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttggggacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaacgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttctttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgatggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaacggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggacggaggcttggtgagattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgtaggacatttcccatgtcctacaagcctcctcctgcctttggtagaggtgagtgtaaataaacaaaatgtttcctgcactcaaatgccctcctctattttatttgttatgggagcaaacttccatctccaggacagcagagtgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaagatggtcttttttttgtttttttttttttttgagacggagtctcgctctgtccctcaggctggagtgcagtggcgcaaactcggctcactgcaagctccgcctcctgggttcacgccattctcctgcctcagcctcccgagtagctgggactacaggcgcacaccaccacgcccggctaatttttgttgtattttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggagggcaccaagccattcatgagggatctgcctccatgaccccaacccctcccatgagtctgccacctccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaaatggcttgcacaagatctgtctgactccaagttctacaggctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcctctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaggaaggaatatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtccttgacatatctgtaacaataaatctttgttccactcatcaccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggaggggagactaaaaaaatgtaaatggatttaccaaaataatctcgaggtaagacctttgaggcttgataccacagaagtgccatattgtttttaagtttctttttttttcttttgtaagtttatttttctcctcggagggcactgaaagttttgttgtgagaagcaataaagttctgttttccaaaagaaaataaaagcatgattgtatttttaaaaatcaatcttaataatttccagccattactttatgagcttaatgcaactcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagcctaagtgtccttatcctgactccatgctctttccagtgagttcttcgccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatgtgtccttttctggctgggagcagtgcctcatgcccgtaatcctagcactttgggaggctaaggcaggaggatcacttgagcccaggagttcgagactggcctgggcagcacagcgaggtctcgactctattattttttaaaaaatagaatatgtcctttcccccttgcctgcctggataaaaccttcttttttatctcttgctgcttcccacttcgcattttctgctctgttaaacatcaaaccgcttctgttgcccagaactatgtctcaggttccacgcaactgtgcctctgcaatgctgtgcctttttcccaaatgctgttcctctacaatccacttagcaaactcctgttcatccatcaaaaccctgataaaacataaccttttaaaagaagtcatcttcatccctctcccacttctagacccaatggaattcacacgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctattgcagagcaatcaaccagaccatgtttccctaataccgattacaaagctggcacagaggcaagacggagcagcagtggggatttatgctctctggacatctgttgggcgtctcttctgataaatcctcgccttgccctgctgatgatctcatctttcagaagacagaggaagcgacagaggaaacggttacttgccactaaatcctggcaacgaggaaacactggttaatgagaaaagtggaatcgttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagaaagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacatatacatacacacacactgaaatccaaatcacggtcatgtgacacgatcaagctatttcttccagccttggcagctttctaggacaggcagccaccctcctttgtgtgctggctcagttctccactttgcttccacctcatgaggctccatctcaacagatgcttcagagcttgcctcattcagggggaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttttgaaagatgagaaagcaagcttccatatgcagcaatgaacactggccaagcccggcctctgtgtactaccaggggagagaggagaaacatgaaaacaaaaattaatatgtagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcctctttctcttcttatagggacactaatcccattgataagggctccacccttgtgatttaattacctcccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgtgatctcctgacctcgtgatccgcccgccttggcctcccaaagtgctggaattacaggcgtgagccaccacgcccggccgaccctttttgttcttatttgatcattccaggaatgctcataccttagtgcctaggtactgtggggttctctcttcctagaacacttctcagaaaatgagagaatgtcttgttcaagtgctattatatttactcattgaaaccttccataattacctacttgaaattatagcatccactccactcctcacactctctatcctctttccttcctgtattttcacattggtaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttttgagacggactcttcctctgtcgcccaggctggagtgcagtggtacaatctcggctcattgcaagctccgcctcccaggttcagccattctcctgcctcagcctcctgagtagctgggattacaggtgcccaccaccactcctggctaattttttgtatttttagtagagatggggtttcactgtgttagccaggatggtctcgatctcctgacatcatgatctgcctgcctcggtctctcaaagtgctgggattacaggtttgagccaccgtgcccggcctagggcatgtcttatttctatatactccttctacaccttttactctggcattgcaaattcctagcaaaacatcctgaagggttcatgctgaaagggcaacctactcttcccatactatcttactgaaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgtttgttttcagggaaatgaggttgagatcaaaaccaggacccagctcatgtgattctgtatcataaagaatatggaagtacatgtatggagctctagtgaaatttgcttggactcagttaagatgcaatggtttgcaagtagttataacacctcaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaattggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacaggaccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcattgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacagaggagaaaactatcatctgcaatccaggaagagcccctccccaagaaccgaatcagcaggcaccatgatctcagacttcccagtctctagatctgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagagatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctctctctctctcacaaacaaacacacacacacacacacacacacacacacaatgggtttgggattcagaaaggcacagttcctaaactggctctgtcatttatcatctatgtgacctgaaggcaattcacttaatctccatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccacgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagcttttggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttgaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgcttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaatgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcagatcctattccattccctttatctccctgtttccattaaaaataaaagcctcggagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacaacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggcgggtgaatcacctgaggtcaggagtttgagaccagcctgaccaacatgatgaaaccctgtctctactaaattaaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcacgcagcccactttcctgactcatgcccatgcaaaccccagctaggcaacaaatacttaaattttttgtttttattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaacccctcaaaaccaacaaaataaaacaaagcacctcttcctttccttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcccgttgccccaaggtctcagaagaggggatgtgctacaatggggagttatgggttttgcaatcagaccctgacacttcactagctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggcgggttcagaaacagcagagaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcttcctgaggtcggctcgatcccaacttcatgtctgtcccatccgccctcttcaattccactctcctctctccagttatgacccctggatgcctgaagaagccttctaactgtgctctccactgttcagctctgctccctccaatctgccctgcatgagcccctgagggatctcaccctttcagcaggtccacctacaagtataacccctctaggtgacataccttccttcgggaagcttctcccagcaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagacgaacaacgacaagtattgacgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgatgtgctgatccacactgcaacacagatgggtctttaaaagctatgtaagtgaaagaagccagtcacaaagaaacatatgttatttcattccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattcctatcacttcctcattgttcaatatggcttcatatatttcttcataaataaatatactgatttaatacgtgtttattcgcttattgtctaccacaacagtaaaggtaatttcaatgagagcagagcctgtggcgcgttcacttctatattcccagtgctttgagcatggcacaaaaggctactgaataagtaagtgccagtgtgtgaatatatgagtacctgtaagaatcagcaaaaataaaatactgtttccagggccccacccccagagattcagacgcaattgatctgagggagagcctgacaaaggtctggctcaagactcctcgagtgataccattgtacaaaccaagacgaagagccctgatccacagcagctgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccagaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacacgctgaaggtagggatctacagagtcacattcatgcaaggtctgtggcacaaggcctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacaccgtatttggtaaatactagtggaatgaattatccgtaccttacatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccggctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatccgatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcatgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagaggaagccagagatacagatgagaggctatccaaggagccactaaatgaggggcttggggccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcacctcttcaggtccctgccatggggaagagagataacgtttgtttgtttgtttgtttgtttgttttttagatgcagtttcgttctttttgcccaggctggagtgcaatggcccgatctgggctcactgcaacctctgcctcctaggttcaagtgattctcctgcctcagcctcccaagtagctgggattacaggtgcccgccaccacgcccagctgattttgtatttttagtagagacggggtttcactatgttggccaggctggtcttgaactcctgacctcagatgatccgcctgcctcagcctcccaaaatgctggaattacaagcatgagccaccgcatctggccagaagtgaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttatattccctgtaagggcagaaattcagctcatgtaaacctcacagcaatccttatgcccatctaacagagatggaaatggagactcaaagaggtaaagaaactcacccaaagaaccccagctaaaacatttagcagagtagggatttgaacccaggcctgtccacctgcacatcccttgcttgtttgccttattgagctgtctcctcaatttcatcttcaccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaagcctcaactgtagaatctcttgattatcaccaagtatatgggcttccaagcctacctaccttcaaagtcaaggtcatcacaaagggataatccctcaggcaaaaagaaagatgagttttaggggtcccctggtttccatagaaaaggcactccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaactcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctatatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaaagtttcctttggtggagagagaagaagaagggtaataggaatgaaaatgggacctctctaaggctgagaagaggggagaaccaagaaagaggagtgtgggagtgctttgttctgccaggtgcagtcaataggtgccttgtctgtagagaatttaaaaaacagtaatacaatcaactattaaatgcaattggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtggtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttgggacattgttaatgttctgtaaagacaaatataaaacaaaatttgaaaacaaaaacagaaagagccacaatattgggcatgaataatccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggcatgaaccaccaggcctggcctcaagttcaggtttgagcagctctcaccaaaatcccactgcagtaaaattcgcagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctccccatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctattgaaacggggtcacacctcccatctctctccattctctatacctactttatctccttaatgctcactacctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagacgatcttggctaacacggtgaaaccccatctctactaaaaaaatacaaaaaaattagccgggcacgggggcgggcgcctgtagtcccagctactcgggaggctgaggcaggagcatggtgtgaactctggaggcggagcatgcagtgagccgagatggcgccactgcacaccaggctgggtgacagagcgagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagatggagaccaccctggctaacacggtgaaaccccgtctctagtaaaaatacaaaaaaaaaaaaaaaaaaaaaaaatcagcggggcgtggtggcgggcgcctgtagtcccaggtactcgggaggctgaggcaggagaatggcgtgaccccgggaggcggagcttgcagtgagccgagatggtgccactgcactccagcctgggcgacagagcgagactccatctcaaaaaaatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcttgctatgctgcctggggtaactgcacaaggccccataattagacgaccccactgtgatgctggcattttgaaattcctataatttttttttttttttttttttttgagacaaggtctttctctgtcacccaggctacaatgcagtggcatgaggctcactgcagcctcaacctcctaggctcaagcggtcctcctgccttagcctcccgagtaactaggaccacagatgtataccaccattcccggctgatttatttatttattttttttaattaattaatttatttttttttgtagagatgcagttttgccatgttgcccaggctggtctcaaactcctggactcaaagcaactccccagcctcagcctccgaaagtattgggattacaggtgtgagcccctgcacccagccagaattcctataattttcataacaagaatcaccacattttcgttttgtgctgggccctgaaaactatgcagccagttctgcccaagatgcttattttatttcattttcccagctttacaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagaggctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcacttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaaaaagacctactacttgatagcacaacagagtgactatagtcaataatttaattgcacttttttttttttttttgagacagagccttgctctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccaggatggtctcaaactctagacctcgtgatccacctgcttcggcctcccaaagtgtggggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccataaatatatacatttattatatacccacaaaaagtaaaaaaaaaaatttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaatagaggaggagagatttctctctaaaaatgtaagggattccaattaaaaatcacctctcattgtacatgcagaaaatgtacagtgagacacaaagttgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacattaccagttagattttccaagcacagttcatactgcagaattcacctaacttgatttaggtttctcctttataatcagtttccacttgaacttcaactaccacgaaaaagtaagtaagtaaagcaaagacgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgccagaagtttattccaagcctctgacagtaggagtcctgaaatccacctggtggatgaaggaggaaacaaaatttagaggacttggcagaatcacagaatgtggggagatgtttccaaaggggacctcatctcatgctgcaaacgttttgtctggagaataccaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaatgcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcactagctgagtaggtttcctgcaggcaatgggagacgcaaagttctgcacttaagctcctgtaggggaaaaagcagagccagcgtgggttggggccaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggataggaggaatgcttcagcccaagagtttgagaccagcctgggcaacacagtgagactctgtctctacacactttatttttttttgttttttttttttgtttgttttttaaattagccaggtaggatgctacaggcctgtggttccagctacatgggaggctgaagtgggaggatcacttgagcacaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctctgttagtgtactggtatggaccagtagggtccatacttgcacaaatcccaacaatcggtatttacatctctttgcttggccagggcccacaatgcctgtgcacaggacaggtcggaagtcctggagaattaacatacctcctgcattaggtcttcaccagtgactaacaggagggacgtataaatatcccagctccttcactcctccagggggtgattctgagctacatgctcaacactagggttggcaaacttcttgaaaaagggtcatatagtaaatattttatgttttgcaggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttccccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatacttttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacacggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttatttatcaaatacataagaaaactcatttaatatggttattttgattgcatgtgctcttgggttttagctccctaatagccagagcaaaagaaaaagaaaacataaaggacacatgaatatcatcatttaacaaagggaagtatagctgttcacaggaaaggaaatgatttttcttagaatagaattcaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctacccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttgggttagacgaggtcatgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttgtattagtccattctcacactgctaataaagacatgcctgagactgggtaatttgtaaagaaaaagaagtttaatggattcaagttccacatgttgtcatatgccacacttcttagggatgaatgaacatcaccatgatgccacacttcctagggatgaatcaacgtcagaattttttttttttttaagttctgggatacaagtgcagaatgtgtaggtttcttacgtaggtatacatgtgtcatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctttcttctctcccagctgggctgggcttcaggtgcctcctatatgcttcctccatatcacctccacccttgcttgtcattgtctgggtttgtattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaccttgcttggagtggcatcaccccaatctctgcctccatctggatatatcaccttcttgtcttctgggtgtaatatctctccacctttctcttataagacacttgcaatcaaatttagggcccacctagataatccagaataatctccccatgtcaacatccttaatttaatcatacctgcaaagactccttttccttataatttaacatatacaggttccgcggactagaacctgctatctttgagtggccatgattcagcctactataggtttcatcactatctctttatcaactctgaagtccttgacagcagagaccacctgtggccattttcaaatggctgtacatttttacatcaaagcaatcccttagggccaggcacggtggctcacatcagtaatctcagcaatttgggaggccaaggcaggcagatcacctgaggtcaggagttccagacccacctggccaacacagtgaaaccccgtctccactaaaaatacaaaaattagctgatgtggtggtgggcgcctgtagtcccagctgctcgggaggctgaggcacgagaatcacttgaatccaggaggcggaggttgcagtcagccgaggtcacaccactgcactccagcctgggtgacagaggcagactccgtctcaaaaaaaatacaaaaaacaaacaaacaaaaacacacaacaatctcttgggatctacaccctctcccttgactttaatgacctccatgattgctttgacgtattgaatatggtggaaatcatactgtgcccttttccagtccatgttttaaaagactatcaagcgctacttcctatatcttggaatactcacttttggaactcagacaccactatgctacgagaagcccaaaccacatagaaaggccacatgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacaaaactctagaagctatggattctagggagttgagctggagatcaggaggaatggatattaggtctcaaagaaatgacaaggtaataaggtagaagaagaaggctgtggataaacaaattttctggagccttaatggtggtgagaagtgggcaagttcaatgttgagcaggaccaaattcaacagaccctcagcaaatgtttgctgacttagcagtacacagattctgcacacatcttccttccttttaaccattcctttaattgtataagcaatatattgagtatctactgagagccaggctttgagttgggtgaagactattcagcagttaagtccctttaacgcttatacactgttgatgggaatgtatattagtccagtcactggaaagcagtttggagatttctcaagtaacttaaaatagaactaaggttgaatccagcaatcccattcatgggtataaatcccaaaagaataatcattctaccttaaagatgcatgcacacatatgttcattgcagcactatttacaatagcaaagacacgaatcaacctagatgcccatcaattgcagactagataaagaaagtatggtacatatacaccatggaatatactatgcagccataaaaaagaatgaaatcatgacctttgcagcaacatggatggagctggatgccattatcttaagcaaattaacacaggaaaagaaaaccaaatattgcacattctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttatccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaaagccagaccattcaatgctattgcttctctcttccaaatgggatgaagtgcaggcagtaaacaaaggaagatgaacttggccaagtccttctattcattttgtggcagtgatgacaatttcccattgtggggagctggaggggcagtctccttctgttcaaatgactcagtacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctcttttcccaactcatggttcttaagaataactgaagaatgtgctagaaatgcaacatcttgagatagagagggactggccagaacgacccaacctctgtttcagtccacccctagaaacaaaatgtcttaaacactttagcccagcaaatcacacatcctggggtataaaacacagaaccagctgctttctggggtatctgagcttctgtgcaagtaaggcatgcacagatatgactctacttaccctcagcaggtttccggggacttggaggaatagctcacaatgaatcctaggcttctaccatctcttgctgcctatctgtaagtaataaacctacctcaggtaacttgttgtgtgggagtgttctgtctcactggacaagttggtagccagtgaacagtgaacctgcttcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggattttcccagccagtgactgggcacagtggaagtaacggaattaggtgattctaacccaactgggagttgtccaacagagagagttgccttaggaactattacactggctgatacattctcagagttgtgccgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgtgcctgtgatcccagcactttgggactctgaagtgagcagaccacttgaggtcaggagttcgaaaccagcctggcaaacatggtgaaaccccatctctactaaaaaaatattagtcgggcgtggtggagcatgcctgtaatcccagctactcggcaggctgaggcagaagaatcgcttgaacctgagaggcagaggttgcattgagcagagatcatgctactacaaatcagtctgggtgacagagcaagattctgtctaaataaaatataatgataatagtaataataatgcagtttcaaatagctagaaggaagatactgaatgttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaaagaaatatagaatgttatacttgtaaaaagaagaaaatggaaactgaggaatcaaattatgtaagagtgatcttccttctcatcagctatcattttagaaatttgtaggaaaagaaaaggagataaaggaagacagcaagaggaagcaaataagcagagggaggaaaagagcagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcgcaggttacggtgagccgagatcgcgccactacactcaagcctggcaacagagtgagactccgcctcaaaaaaaaaaaaaaaaattagtaagagaatgagaacttcatacagaagttgaaaagtggatttgaaatcagtggagactgggaccttgtacaattaattctgttttgccttctgctactcagaggacctgaactgactcacctaccatctagagacagctactattttgtatttcttttttagtttcatgcatttaatttgcatgattatcattttgctttatttctccattttacattataatatgtgccacctcatgttactgtgcttcatgtctattatcgatgccccataacattctattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagtcgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttctttcttttctgtttttttttttttttttttgacacagagtcttactccatcacccaggctggagtgcagtggcatgatctcagttcactgcaaccttcacttcatgggttcaagcaattctcatgcctcagcctcccaaaagatttccatggaaggtgcttgcaaagggaaaaataacttgtgtggtcaaaaagtttagaaacccctggtctaaacggcgctagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagcactttgggaggccaagatgggcagatcacttggatcaggagttcaagacagcctggccaacgtggtggaacctcatctctctaaaaatacaaaaaaaaaaaaaattatccaggtgtggtagataattatccagtagtctcagctactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaacgctcagagtgccactgttcaagctcctcttgctccataatcactttaaagaggctgcccccacccccggggctcagagggcttcctgtgtcctgacactatgatcgtgagcgagcgccgcgctctgttcccaactatgcttcctcatctgtcatccacggcttttcttttaaggagttatttacgaagaggtgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgagaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatgtatcatgttgaatttctcatctcttgtgaatgccatgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatccccgaattctattcatgatagaatgtttgagcatctgtggaccccagtttgtgaactcttgccctgaaacaaagcctgccagttatctgtgttcagtcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataattaaactgcagaggaaagagacttaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccactgctgctttgcttagctaactcctacccatcctcaggtctcagctcagcaaagtcacttcctcagggcagtcaagctttgccactcatcaagactaggtaaaattttcttgttaaatctatttatggattttcctggttctttgtatttttcatcatcttagataggttaggtttccccagaaacaaatcctaagagaaggtgagacggtttggctgcgtccctacccagatctcaccttgaattgtaacaatctccatgtgtcaagggcgggggcaggtggagataattgaatcataggggtggtttcccccatactgttctcctgatagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagttcctatgccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacatgtgaaaaaatgctcaacatcactaatgatcagggaaacgcaaatcaaaaccacaatgcgataccgccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactctggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaagaggggtgtctaaggccctctctgacattctaacaacccccatcatctcttttgctggccaggggcccacctggtaggacagtccaatccagggtaattctggctcacaggtcacgcaataccaatctttggtcccaaggttaggagtggctgctctcacaatggactttataataacctctccaacctctgtttgttgagcttagattcttaagcctctaagcttctgatgactcttactagagaaagtaatataattacccatcaatagagaaatggctcattcagcaaggatatatctgttcaatcaaatatatttgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccatggcccacgcctgtaatcccagcactttgggaggccaaggtgggtggatcatgaggtcaggagatcgagaccatcctgccaacatggtgaaacctgtctctactgaaaatacaaaaattagctgggcgtggcggtgcgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggcttatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcacgatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatgcacttctttggttttgctcttcctctttctctctttcccttatccctgctttcttgagattgcgtgacccaatgaaacattcacatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaattcaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaataaagacatacctgagactgggtcatttttacaggaaagaggtttaatggactcagagttccacatggctggggagcctcgcaatcatggtggaaggcaaggaggagcaagtcacgtcttacatggatggcagcaggcaaaaagagagcttgtgcagggaaactccctgttataaaaccatcagatctcatgagacttactatcatgagaatagcatgagaaagacccacccccatgattcaattacctcccaccgggtccctctcacaacatgtgagaattcaagatgagatttggatggggacacagccaaatcatatcagtgggacaggatggaagctgggctcagagcaacttctctccctttccatgtcatctcagagtctctccaggtttccctccagcaaaagccctcagatttctcacacagtggctcaggggtttaaaaccaagagttccaagaggtgtaaggcagaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaaactgggaggaggggtgggtggaagactgaagcattagagtaagaggggctccttcatcctccggtcatcatttgccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaacagccacataagcatcttatttggagttacagagataaataaccgaagacctaaaaatggaaacaacatttcaagcacttgcctccgggaaataagacttaaggaggggagagaggagagaaggggccaggaaccgctgctttcattagcagctcctctgtactttaactttgtacgatgtgctcatattactatgatttttttttttaaattcaaaagggaaaaaaataagaacaaaatgatgatggttatttttaaaactatgtaattaaacctggaaaaatctcattttgctaaacggaaaaaaagtagcaggatactaaactatattaatagtatggtcataagtatgtttaataaagaaagagaaaaacatatatgggaggagaaaaatctgaagaaatttactaccaaatgatagtgggtgggtttctctacttttctaggtttcccacattttcagcaacgtgattctcatactttcctaatgaaaagaaatacattcattacataaaataaattaactgggccaggcgtggtggctcatgcctgtaatcccagcacttcgagaggccaaggtgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaaaataaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctgaggcagagaattgcttgaacctgggaggcagaggttgcagtgagccgagattgcgccactgcactccagcctgagtgacagagcaagactccgtctcaaaaaaaaaataaaaaaattaaaaaataaaaataaaataataaaataaatgagccgagcatcaattaaataaaatgccagaagggtctctgaagaactttccacaatagaagtgtattttaagtccctgagccttcatctcatgcctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacaggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggcagatcacttgatcctgagagttcgaggccagcctgggtaatatgacgaaacctcatctctacaaaaagtacacaagttagctgggcatggtagcatgcaattgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaagcggaaaagctgttgccagcacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttatctcagaagagttataagaattaaactagagaagaagtgagcattgtttatatgtgcttgttgctatggatccaaaactgccagtaataacaataataataataataataatagcttatgctttcgttgagcccttgctttgcacctggccagtgacaggcacattatcagtaacacaaatgcaagtatctcatctaacccttgcatcaacgctcagagatgggttttatcagcatccccattttacagatgaggaaaactgaggcagagcagttgcacaacgtcgcagctgttcctggtgcttcacccagatcctcattgccagtaaaccactcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcaaggcagaatacactccagagacccacgtgagatcaaggctagcctcagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccccacgtgaaaccaccaagctgcaccaggctcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtttatttgttctcacgctgctaataaagacctacccgagactgagtaatttacaaaggaaagaggttgaatggactcacagttccacaaggctgaggaggtctcacaatcatggtggaaggccagagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccccgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcggccgggcgcggtggctcacgcctgtaatcccagcactttgggaggccgaggcgggcggctcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcactgttgcacaccagcctgggcaacatagcaagactccgtctcaaacaaacaaaaaaagggggaggggcggggctttagacagatccaagctcaaccctgcaagttgccgagactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttatccaaaatcaaagaacttctacaaaatagaaacagccccctgccccctcctgcccccgcccgcctgctaccttaataggttgtttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcgtttgtaggcagaatgggttttcttgagaccattacaaacagactgcctaaattgcaaagattccaggcttgacagctcccggaggactccagatggaaagaacaccacccccatctcttatacatccaggctgctgtctgtggatgtccgaaggttttcccaccacccatgctattgttgaaattccacaatcaacctgcaatgccccagtgaaccattttgctgggatgggaggaccaacttagggccaaccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagacgacaggctaggataattgatcattagaacatctgtgctgtttttgttgtaagaatagtatcaatattaataacaacagcaaatatatattgagtggcttctggagccaggcactgtggtaaacttttgcacgtatcctctcacttaatcctcacagtgctctacaaagtgggtactggtttcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgccagctactcaggaggctgagacaggagaattgcttgaaccccgggagacagaaattgcagtaagccaagatcgtgccactgcactccagcctgggcaacaagagcgaaactccgtctcaaaaaaaaaaaacaaaaaccaaccaaccaacaaacaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggtgaaatcaagctaattaacaagtggtggggatgcttcaaatttactctcttagcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcacctgaggtcaggagttcaagaccagcctggccaacatggtgaaacctcatctctagtaaaaaaaaaaatacaaaaaaaaaaaaaaaaaaaaaaaaaagctgggtatggtggcaggtgcctgtaatcccagctactcgggaggctgaggcaggagaattgcttgaacccaggaggtagaggttgcagtgagccgtgaacgtgccattgcactccagcctgggtgacaagtgcgaaactccatctcaaaaaaaaagataaaatacaaatacatccatatataattaaaatatgatagtggtatgttttcctgtttaacaaatatttacttccctctcattcccttcaccatgggaagaacagaatcctctgccctgttagtgatgggtttgttttggccaatggaacatgagcagagctgacggtgcaccagttcccagcttaggccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaataagtgtttatttttataaccatgagggtggtgttacttgttacacagctacaggtaactgatacatttacacgtgaatatgtgcacatactatacatgtgcatattatataggatacatatgtgtggccgtgttacatggaaatagatacgtataaatccttaaaatgtatctccatatgtgggatatttatacatatctatttgggagatagtaaatggggtagaatttggagactgctaaatttgcattcttgcgttgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggagaaaaaagcaaaaataaaaaggataaggagagccagcagccccggaggaggagggagggaggcataggatgtgcctgtgcctggcacgtagtaagtgctcaattattggtagccatttttattctcaaagtgattaacgtgagaacaagggggtcaactggagatttaaaaaataataatcagtctctctgctccgcagcagacccctgagacccttggcaaaccccagcaatagatcaaggaccttcagtaggtgaatacagtcgcaggaactgctagagctgacacatagtccctgcaactccagccagacgccagcaccagctgccactgggagatgtgagcttggcttctccatgaaagagaaagattcctggggcctcagccgtgcctcaaacccactgataacatcaaacacacattgctggggggagccggccaggtgctcagaagctgcagggtgaccctgcgtgtaggtgtcgggaagtcagcagcgactcgggggtggagaaacacccacacctttgcaaacactcttaatgtaatgcactgcccttgaggccacctcccgtttttttggccctaattggcatgtttttctatctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaaccttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcgattgtgattagcacagagtgaagcagcgtcattctctcgggggtaatacccgagattcgttgcctcataccaaaaacattaaggacacagacacacacaaagagtgagtttaaaagcagaggtttaataggcaaaagaatgagaaaggagaacgctgtctctcttccgagaggggggcacccagtgggacttctggcccaagtcagagtgcaccagattttacacggttggggaggcggtgcctgatttactagggcccaaagattggttgcaccaggtgtgacatttacatagcgcatggggaagttggccgccccaccctagtgttattatgcaaatggggtctttgcctggctggctccttgttgcctgctccttactgtacacatggctggcaaagagaagggaagatggagctgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggtttctagggtgactatccatcctggcttgagcactgcaagtcccacactctgggaatccgctcgggcctgggcaaaccaagacagctggtcaccctcgccgtaacataagtgagtgaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgtcctttactggggagtctggggacagccctgtgccttgtaggatgtttagcagcatccatggcctctacgtactggatgacagtagcacagtatgccctagttgtgacaatcaaaaatgtctccagacattgccaaatgtcccttatggggatagaagtgtccccagttgagaaccagtgttgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaaatggaacaagctctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcgtgggggcagatccctcaggaatggctgggtgccattctctcaagagtgagtgatttcccactcttagtttctgcaagaactgattgtgtgtgcgtgtgtgtgtgtgtttcaagatgtaatctcgctctgttgcccagactggagtgcagtggcacgatttcagctcactgcaacctctgcctcccggattcaagagattctcctgcctcagcctcccgagtagctgggattacaggcacccgccactacatccagctaatttttgtgtttttatttttttctatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtgcagagagggtttcgacatgttggccaggctggtctcgaactcctgacctcaagtgatccacccacttcggcctcccaaagtgctgggattacaggcatccagtcgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatattgatgccatgattcttgcagaatgatgagccaaataaactttttttctttgtaaattatccagcctcaggtgttcctttatagcagcacaaacaaagacacttgctataaattgattctattgctcactttttttccccttgtgctttgtttttaagatccatccaggccgggcacagtggctcacgcatgtaatcccagcactttgggaggctgcggtgggcggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaaataaaagatccatccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatgcttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtatcagatctctctagaatgaccgcgccagtccacagtcccagggcttgcttttaaagggggccaaaccccactggcccccctaacacggtgtagacttgcagggctctgctgagagccaccattaaccacaagcatcatgtctgtattgctaccgttcgtcaatacccttgaccatcttgccttaaggaaccctcaatttccaagcacatctccaaatcagagccccaccccctccacaatgcaaagtgggacaatctaggagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccacccccctcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgggttgttttcccccaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggattagacacggcgaccctaaagtcctttcagctctgagactccatgtgacgtgatgtaatgtaacagacacagcccttcctggttccaatccaagctctactactaaacgagtgatgagatggctcaccaactgtacctaccactgactagctgtgtgacccttaactaactgtacctaccactgactagccgtgtgacccttaactaactatacctaccactgactagccgtgtgacccttaactaactacacctaccactgactagccgtgtgacccttaactaactgtacctaccactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtggcccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactgactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaatagcagctgcctctggggctgtagtagggtgaccagccatcctctttggtttatctaggaccgaagtggttccaggtatagggaacgctcagtgtcaaatccagtaaagtgctaaagcaaacacaagtttgtcacccaaggttgtagtgagaactaaaggtgaatgaggtgacatggataaaatctagcacatcaatataagttagtatcattgctattgctattgctattgctttttgtttgtttgtttagagatagagtttcactcctgtcacccaggctggagtacaatggagcactctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcacgctctgttcccactacttcaggccctcaccacattggccaggctggtcttgaactcctgacctcgtgatcctcccacctcagactcccaaagtgttaggattacaggtgttgagccaccgcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtacgggccctccaaaaggtttaatgtctctgtggtgtcatcccaaagagaagcacagagaagcaagaggatctgcagctggagagcccagaggcaatgaacactcaccttgactctcttctcatttctgaggctctatcagttaaggttcttagtttgcaagcaacagaaccaaatctttttttttttttttttttttttttttgagacaaagtctcactctgtcgcccaggctggagagtagtgcatgatctcggctcactgcaagctctgcctcttgggttcaagcgattcttctccctcagcctcctgagtagctgggagtacaggcacacgccaccatgcccagctaatttttgtatttttagtagagacagagtttcaccatattggccaggctggtctcaaactcctgacctcgtgatctgcccaccttggcctcccaaagtgctgggattacaggcgtgagccaccatgcccagccaacagaaccaaatctttacattaaaaagcggggagcttataggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcacggtggcttatgcctgtaattccaacagtgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgatgcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaagatgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgcccgcgaacaagatcctccagttagcgttaagcagattaaaggttgagaagcactaggctgcagggtcgtggaatgactggactctaatcactctacatccttgatgatctctccttaagatgcaaattcccagaaggcaagcatgtgatgggccatgcttttgtcacaccatgatagaagatctgggcataagaaattctgcagagtggtcccaccagacccacaggcaggagaagggccatccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaagtttagcacggatcagaatcacctggaagatttgtaaactcacagacttctggaacctaccctcagagttgccggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattagggaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtctttaggagggagagactgggaaacattaataccagagccctggctattatttgcaatgtatagcaatgtttttcctcaaggtagatctttggtgagccgtacacagtaaagctagccattcaggtggaattacatccaactagtcatctctgtcatactaaaaacagtaaacaatgcttgaagaagtcagatgcctggcatcaaatctaagatccaccatttactggctgtggtcattaggcaagatgcttaacgtctttgtaccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaagaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacgtggggcttacagctccctccctcgacgcaacacctggtgattataattcaagatgagatttgggtggagacacacagccaaaccatatcacctattttatttatcataccattagtgttattattattattggtggatgtgctggtggcgttaatattgttggcaaaactggaactagctggatctttatcaataattgcaatcatgattctgacatctgacccttccatgccactggtaggcatgtaaacaggcacaatttttctggaaggtcatttggcaatatgtatcaagagccttacaaatactcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttttgaaattacactatgttcgtacaatgaaatcttcttccaattattaaaataatgttcatgccttttaattggggtgattgtataattttatatctttataaaaatatatgtatgtaagacttcatatagatgatgaactcagttatgtaaacatatgatagaaaaagagaagggaataatccaaaagccatctgctctgggtcttggaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaaacccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatggttctcaaccaggggtgattcctcctcctcccctcaggggacatttggcaatgacaatggggcagggggttgtgctactggcatctagtgggcagagcctagggatgctgctacacaccttacagtgcacaggacaaccctcacccaaaggattatctagcccaaaatgtccacagtgctgagactgtgaaacccagaattaggatgaccttataagttattgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacaaagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgctgcttcgaaaagctgtctctggcatggcccctactgcagcggcgcgtgacagactgccttgcttggtggaaggaatcccaccccgattaaattgctggagccctgctgggaaggaggtggaggcaggaggagaaggagagtagggagccaggcaagccactcctgcctctcctttttcatcttggaagagccaatttcaagcttgcctcgggtcataaaagaaattaatttgattctctcagccttgctcagagtggacacacgtcttcggctggagcatctgctgctgctggatccagagcaaggagaccatcccctcgaaacgattccatttctgttgcaaggcagggccagaatcatctgcctggagctggagaagcagctgcctggaataccctgggctgtcatttttgctggtaagttccaaaaacggttctcacagctaaggtgactcccaagtctcaggaggtttacccagagagatacgcacgggtggggctggttcttggaaaactcccaaccagaatttagcactggcagctgcctaacccacttcatattgatcagcttgatcacactgagtcctcttaactgtcaggcacggcccctgggctgtattcctgattgcacacagctaaggtgactcccttgtacaagcctccccgcctgagagaggatggaatttgtgacctgcttctaatcaacagaatatggcaaaggtgccgaatgtcactctcttgatcatgtttccaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgggcgtgaaggcacctgcctgtggtcccagctacttggcaggctgagatgggatgatcccttgaatctaggagttaaaggctgcagtgagctacgacttaccactgcactccagcccgggtaacagaacaagaggctgtctcaaaataataataataataataataataataataataataataataatttcatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccttcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccatgtggctgtggaggcctcacaaatatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagatttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcgcttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgttctcaatctcttctttctttctctctctctctctctctcactctctctcccccatcttctcgctccccatctccctctctccctctctgtctctccgcccccccatgtattagtctgttttcacaatgctaataaagacatacccaagactgagtaatttataaagaaaaagagcggtcacggactcccagttccacatggctttggagatctcacaattatggcagaagacgaatgaggagcaaagtcacgtcttacatggtggcaggcaagagagtgtgtgcaggggaactcccctttttaaagccatcagatctcatgagacctattcactatcacgagaacagcatgggaaaaacccgccccatgattcaattacctcccaccatgtccctccgatgacatgtggaaattatgggagctacagtttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttccgaaggaggaatgggggtggacaaaaattattggctgagaaaatagctggtgaatgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctacgtctcatatctttgggagcatgggtggtttcccccaccctccattttcctcttctctctgaacaaaagttttagtttgtgaagtcaaatctcatctttttttttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacatcttgctaatttttatatttttagtaaagacagggtttcaccatgttggccaggctggtcttgaactcctggcctcaggtgatccacccaccttggcctcccaaagtgctgggattacaggaatgagccaccacaccctgcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacattgggggttagacttcagcctatgaatctgagggcaacacaaccaatgtctgttagttcacggcagacagtgaaatagtggaaaggagggtgtgattgattctgggaagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagaatatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcctccttccttattgtacttattgtctaaccttaaggtacttccttatggtaccattttcacacgctgataaagacatacccccacaccccagactgagtaatttataaggaaaaataggtttaatggattcacagttccacatggctggggaagccttacagtcatagcggaagacaaaaggcacatcttacatggcagcaggcaagagagaatgagagccaagcagaaggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaagaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaatcacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcgcctggtatatccatcagagaccaccaatgtgttcctgtcaccccaacaggaagcagagaacccaaggctgtgttggcaagtagaagaccctagggacccagagggcccagagagcccagggattcccagtgcaaaccctcagatgccttggtgccttaaggaaaaacacaccagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttcatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagattgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaaaaaaaagagcaatagaaagagagaattggatgcatgctataacagcctatgatggtagatccagctggtctggggaaaaaggagagtatccaactaggcttccccaaggtcatgaatttttttttttttgagacagtctcactctgtcacccaggatgaggtgcaatggtgcaattacagttcactgcagcctcgaccttccaggctcacatgattctcccacgtcaacatcctaagtagctgggactacaggcatgcagcaccacatgcagctaattttttgtttttttttttcttttggtagagatggggtctcacttcattgcccaggctggtctctaactcctgggctcaagcgaacctcccacctcggcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggtaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccattacctatgacatcttcctctgaaataagctcaacagatgatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccaatagttttctcccagtggagttagaaggatagctcctaatgctctgtattagtctgttttcatgctgctgataaagacacacccgagactgggtaatttatgaaaaaaaaaagaggtttaatggactcgcagttccatgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacgacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttgtgggtagcagagtcaacaaatggacgaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcctgggctaatgctatcctcccatctcagcctcccaagtagctgggggcatgcaccacatctggctaattttttgacttttttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgccagcataggtagaatataagcaggcagagcagcatagaagggcttgactggctgagtcttccagccttcatctttctctcgtgctggatgcttcctgccctcgaacgtcggactctgagttcttcagctttgggactcttggacttttgaccacagactgaaggctgcactgttagcgtccctacttttgaggctttgggatttggactggcttccttgctcctcagcttggagatggcctactgtgagacctcacctggtgatcgtgtgagtcaatactccttaataaactccgctttttatatacatctatcctattagttctgtccctctagagaacgctgactaatacactcccatacggaggggcaagggacagagcctttgtaaccctccaggattatgggatgcctaggaggggaggaggatttcccagcactaggtggcttcctgcaggtgccttcttgccagaggcaggactttgctatgagctgttagcagctaggtctcccagcagctggggggacagagggcctcggtggtcctgcacagaggtctgagtggtgcagcacccacagcgaagccagtgaccaaagtggaaagataaagatatgaaaatctttcaactaattaagatttaaaactcagattgatgtgaggatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacggttcacacctgtaatcccagggtggccaaggcaggaagattgcttgagcccagaagttcaaggctgcagtgagctatgatcatgccactgcactccagcctgggtaacaaagcaagaaaaaaaaaaagcaagaaaggaagggagggatggaggaaggaaggaagggagagagggaaagagagagagaaagaggaaagaaagaaaaagaaagaagaaggaaaaaagaaagaagaacgaaagaaagaaaggaaggaaggaaggaaggaagaaagaaagaaagaaagaaagaaagaaagaaagaaaaaaagacagagagagacagaaagaaagaaagaaagaaagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgacgggggtgatgctccctccaagataacaaagaaaacctggccaggcacagtggcccacgtctgtaatcccagcattttggaaggctgaggcaggaggattgctagagcccaggagttcaagaccagcctgggcaacatagtgagacccctgtctcttaataaaataagaaaaaagaaaaggaaaccttccctttacatgaaggcatcataccttaaatgcacatcccatctgcccaggaggctcacctctagatttgtatcctactgatgaacacacaccaagatggacatactagcataaattgtggagaatgacagaaaatatcctgaatgtccaccatgagggaactgattaatttatacacatccgtatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttttgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttataggcatacaaactaaattaattagccatccctatagcttcaacatgcatttcaatttgcaagcaccctggcctccaagattgattgattggctgtaaattgagaacctcagcaatttcctttcacagggacagatgttgacattattcctgtgatttttcacagatgtttcccttccagcatctttaaaatcgagttttctgtcaatttggaaatcccaaatttctcatatcaaatcgagatgacaggaaaatcaaaaccgttatcacattttgaaagagtttatggatggcaaatgacactgggaagggagatgtttaaggagcagccgacgtctcttaaccctttctcatcacttcctgcctcagtttacctaagccagcaaaaggggaaatttgattcaatatacagacaagggctttagagtctgcgtagcggtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgttttttcctttttttttccctttccctcctccttcaccaatcctccaagcagcttttcttccttcttcatgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtgacaacaggcaggaatatgatctactcatacaaaccaaacctctgctgtttgtacatcttagctaataatgcccaacacacagccaacatttactaagtcaggctcttgagagccacttcatctgcatgacgccacaaaatcctctcagcaacaaaaaggcactgttattatttctgttttagagatgtggaaatgagcaccagaagtagatgtaacttgacaaatatctgggtggtagatctggaaatcaaagaaccctgaaccccaaccacagacacatcttcagttcaggctgggtctctacgctttgttatttttaacggggcattacgctccctggatggctatgatgctgcagttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgtgatgtgtccatattagaagagacaccagagatacctttctctctctctcactcttgcttgatctctccctctctctcttgcactctctctcatgcttgcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtctttcctccaaccaataatagatggcttgtcctttccatcgcccaccttgggcaaggcaaacaggacagtgaaggcaagcacatctcacagacaccagcattcatgtgctaatgaggctcactactagtattgcaaagatgggaagtcaaacagaattatgtccttgcgaacatacaataacttggaaaattttattgaaagacattaagtttgcatacacacaaaaatgagtgaagagttttttgttccattgaataatttagaggacatctaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatattatcaccgcctgtattgattggggttttccagagaaacagaaccaatgtctaaacagagagagagatttcacgcaattatggaggctaacaagtgctgtcatctgcagggtgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaactagctgtgcacctgtatccctaagagttaacacataaaacctaccatcccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaacgcctgcccagctgcagccaaacgttccatagacaatgtctctgggccttttgtggcagaaaaaccaacataaggaaaagaaggctggagatgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctacccaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaatcagctgggtgtggtggtgcacacctgtaatcccagctctttgggaggccaagacaggtgaatcacctgaggtcgggagtttgagaccagccaggccaacatggtgaagtcccatctctactaaaaacacaaaaattagctgaacatggtggtggacacctgtaatcccagctacttgggaggctgaggcaggagaatcacttgaacccaagaggcagaggttgcagtgagccaagactgcgccactgcactccagcctgggtgacagagcgagactctgtccaaaaaaaaaaaaaaaaaaattctcagacaaccagcagtgatacaagagataaaaggcatctggctttacgctgcaaacaaaagggaaacaggaagtgagagagcagttggcctctaagaagcatccatttgttttaccctgccaggtgcctacaaggtgatggttttgcctcccaaatataatcaggggcccaatctctgcattcagagaagtatatttcagcaacccataagtaatccaaaagcagttccccacacatcagctcaaacagtgttacaggacaggcattcttggtgccatcagatccaatgtcccatgttttaaccaacaattgaaaagccctcttttttttttgagacagggtcttactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaaatgtgctgatcctataacccatctactcttctaaccaatcacaattgtgccctaattataataaaaaggagaaatgaaatgatgaggatttctaatgaaataatatatagagaaatgatatgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccaaggtgggccgatcacaagatcaagagagcaagaccatcctggccaacagggtgaaaccccgtctctactaaaaatacaaaaattagctggacgtggtagtacccgcctgtagtcccagctactcgggaggctggggcaggagaatcgctggaaccagggaggcagaggttgcagtgagccgagatggcaccactgcactccagcctgggtgacagagtgagactctgtttcaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacaaacacacacacacacacacacacacacaaacacacacacacacacacacacaaacacacacacacacaaacacacacacacgggacaattcagtccccagtgagaacctctgtaataaaaggtccaattcctaacccgcaataatattcttttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgcgttagccaggatggtctcgatctactgacctcgtgatctgcccgcctcagcctccaaagtgctgggattacaggcgtgagccaccacgcctggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtgtgataattaaggtaattatttagaccaggaatctgcaaaatacagcctgaaggccaaatccgagctgcttgttttcctatggcctgaaagctaagaaagaatggttcttacattttatattattattattattattattattattattattattattattactattttgagatggagtctcgctctgtcgcccaggctggagtgcagtggcaccatctcagctcactgcaacatctgcctgccaggttcaagcgattctactgcctcagcctcctgagtagctggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgtactacaatggcagggttgcatggttgcaagagagcacatggcccccaaagcctcaaataatccactatctgggcctttacagtaaggttgtcagcccctggcttaggcactaaacaagtgctttcaagcacctactatatgccagacactaaggtaatagagaggggagacaatcaacaagaagcattctttctcaaaagttttaggctaggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagttaattaattaattaattaaattaaaagcatgttattcagaatcacatagacttgggctcagctcttcagccataagcatgtttcttttctctttttctttttttttttttttgttgagacagagccttgctctgtcacccaggttggagtgcagtggcacaatcttggctgactgcaacctccacctcgtgaggtcaagcgattctcctacctcagcttcctgagtagctgggattacaggcacgtgccacgatgctcggctaatatttgttttccttttttttttttttttttgagacggagtttcgctctttttgcccaggctggagtgcaatggtgcaatctcagctcactgcaacctcctgccttccgggttcattcgattctcctgtctcagcttcccgagtaactgggattacaggtgcatgccaccacacctggcctaatgtttgtatttttagtagagacagggtttcaccatgttggccaggctgatctcgaatgctgaacctcatgatctgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgctacccccttcaaaaataataataataatatgaaagttgggaagtggaaaaccatcctctggagttttcaaaaactaattccattgtaatcatagaagactgaaggcaggattcatgacacatttctcttcctcctgggcagatgaatctacaatttgtatttgattttaaatgtgattctcctgcatcttcagtgggtttgattgatagagcacatggggccactcagtaaaatgatacagtggagatcaaagccggaaagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcgtaaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccctggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacaattgcttgtcaaaaaaagagcctcatcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccactataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgatgggaggttggatgaatgaataaaggagtgagaaagttaattgcttcccttctctgggctgctgtatcaatcaaggttgtggcaggaaatacatagtaaactgaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcgagtgctggaaacttaatccctgatgcaaccgtgttgagaggtgaggccttcaagaggtgtttggatcatggggacatcatctttctgaatggattaatgcctttatcatgggagcgggctggttttcacaggagtaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgctcataagagaaaccattctccaaagcccagagtaattatagagcccataagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccttttccttccacctggaggttagcaggaactttcaaaggtttagtgtcatccatatcccattgtcttcttcatgcacagaaaagacaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgagatatgcatgtaaagtgcttgatataatgcctgacatggaaaaaacactcaataaacgttagtcatcagtatttatatcatcattccttttaatacacgccatcgactgggtgcagtggctcacgcctgttatcccagcactttgggaagcagaggcgggaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggcgcggtggcttactcctgtaatcccaacactttgggaggccaaggtgggtggatcatgaggtcaggacttcgagaccagcccggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgcactccagcctgggcgacagagcaagactccatctcaaaaaaaaaaaaaaaaaaagaatgaataagacctactatttgctagcacaatggggtgactataatcaaaaacaatttaatcgtacattttagaataactaaaagagaataattagattgtaacacaaaggaaaacgcttgagatgatggataccccatttagcctgatgtgataattacacattgcatgcctataatatctcacgtaacccataaatatatacacctacgatgtagtcacaaaaactaaaactaaatataaaacaacaagcatttatcatctaattgtctggatttggaacccacaagccaactcagctaagtgctctggcttagggtctccaatgaggctgcaggtaagatgtcagccaggactgcagtcatctgagcgtttctggggctgaagactaggcttccaggctcactgtgtggttgtctctattccttactggctcttagacagaaacctcaattcctcaccacgtgggcctctccataaagtgccttagtgtcctcaaaacatggcagctggcttcctccaaagcgactgatccaagaaagagaaagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgaatctcgctctcgctgcccaggctgaagtgcaatggcgcgatctcagctcactgcaacctccgcctcccgggttccgggaattctcctgcctcagcctcagcagagttccccaagggtacctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttcttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcaaactcttaacaaactatccctgagaggaaaagagaatgaattcatactctgtggagtgtagcccaaaataacctctgcaaaggtgaaattttctttgaagtcttattttaccttaggtatttgtgaactctgcgttctattttgtgccacatgtgttttaagttactattactctactaaagtttattcatcctccaggaagatgatgatgtttgtactgtagttttttatgtcccagggatacagcagggttccccaagggtatctgttggcctagtttgagactcttggctctgttagtgggagtctcaaactatgctccaggctgctgattgttctgagggatttctctttctttctaacactaagaaataggaaacacagttttcagtttaaaaataacataattacaaagtgtagaaaagtctctcttggccgggcacggtggctcatgcctgtaataccagcactttggaaggccgaggcgggtggatcacgaggttaggagtttgagaccagcctcgccaacatggcaaaatcccatctctactaaaaatacaaaaattagctgggtgtggaggcaggcagctgtaatcccagctactcgggaggctgaggcaggagaatcccttgaacccaggaggtggaggttgcagtgagctgagaatgcactactgcactccagcctgggcgacagagcgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgtttttgtttttgttgttgttgttttttcagagagagtctcactctgttgctcaggctggagtgcagtggtgggatcatagctcactgcagccttgaactcctgggctcaagcgatcctcctacttcagcctccccagtagctgtggctacaggtgcacaccagcacgccttgctaattcaaaaaaagaaaaaaaagaaaagaattgtagagatggggtctcgctatattgcccaggctggtctcaaacttctgacctcaattgatcctcctgccttggcctcccaaagtggcaggattacaggcataatccagccattgtccctggcctggctttttttttttttttttttttaatgtagctcatgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgaccgtgagtaagttcttaccctctctgagcctgtttcttcacttggaaaataaaagtatacacatatacagctgttagccagaactcagcctagggtaacctttcaataaatattagcatcatcaaggaaatcgcttgacaaattaattttcattaagcaatgagggtctataacagtgatgacttctgaccaaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagaacacagctactggaatcagaggcagaggagctcctcttgcgttcgttgttggtttcccttggttttgtaaaaataaataaataataaaatagggatacacccttcagacagcaggtaacttcctaagctaagatgaacaggaggaaatttaaatgtctttccccggttcaaatcccctaccctctcccatctgcctaccctgggctccaacactcgggagaaagaccataagtcgttcagatgatgctttggagctggacaatcaatcgtgatcaaaaacaggggcatgggagcctggctaacgtggagggatgggagaaaatcaggctgaattagagaagggtacattgtggagtgtgttttacaacgccattagttctaagcacataaggatttcaaatcaaggagcatccacacacacacaaactcttggattccttaagagataaggcggatccaaaattagcatatagatcagaggcatgcagttgagtgctgctaaagtgggctataaatgcttgggggaaaatagttgtttttctgaagaaactttacaacattccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttatttgcagcctgatatggttcggatttgtgtccccacccaaatctcgtgtcgaatcgtaatccccagtgttggaggaggggcctgggggaaggggattggatcacggggacagacttgccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttcctcagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcactattgtgtcaccttggggcaagtcacccaacttctccaaatgtttgtttcccaccaggaagatggaaatgacagtacctctccttcctaccccgcaaacctatcaggaggatcgaaagggacatggcaagcaaatactttctaaactgtaaagtgctgtgcaaatgcaagacagcattactctctttttatggagttatttatactctacctggttacagcagaggatttatggtagatgtcagtaagactctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcctactaagtgcagtacccagcacgatgtctaacattgaaacatacagtgtatacaccagcacctccaccaaacccatatccagcatgcaaaacatacccttttcaagtcggaagcacatagatagattttttggagttcaaaaggtcttaatgcaaactggctccaattccttttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccaaaactaaaagctctttctttattgctatttctttaagtcctaacaattggtcaggcacagggtcttagctgtgccattctagttaatggtcggttacaaatttccaccataaactcatcttccttctagcaacttaaatctcaggcactgggatgtaataaggagagaaagctcttaggcccagggcaatctctctctcaatcccaatctcccttccccccatccctatcccaccacagtaactgttagtaagagcttttggttgcatgcccagaaatctaactctggctaaattaatcaagaaacgaatatactggtttacccagctgaggtcatttacggaaagggaatgctaaggtttgaatgtgtctcctccaaaattcatgttgaaacttaatccttattgcagtggtattaagaggtggggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagtaaggaacagagccccttaccagacacaaaatgtgcctgtgccttgatcctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctctctctcgctctctctctctctctctctctctctctctgtctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagagcctgatgtttgaccagatatgtgccacttaccaaccatagcagacactggcaatggccacccatgtcccttggaccctccccatcccatacaagctgaaggcctccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacactttgaggtgtgttccatgccatcaaccaaagcccatcaaaaggaccaagccccggctgcccatagaagtaacttactcattaccttgctctattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatcggtagacggaggaaagcaggttgcactccagatgtgcgtggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacggctctttctggatctcaagcctgctggttttcagactggaactacaccactgggtctcctgggtctccagcttactgactcattctgcagatcttaggacttgtcagcctccataattgcatacacacacacacatacacacacacacacacatatatataaaagtgcatatagatacatatatgtatgtgaatgtatgtatataaaagtgcatatagatacatatatgtatgtgtatatatatatacacacatacacacacatatatgtgtgtgtgtgtgtgtgtgtacatatacatgtgtgtatatacacacacacacacacacacacacacacacatatatatatatatatatatatggaccatagagaagtctctaagccaaagctggggacaggggaatcctgtgtctccttgggagaggtctgctttagtgtccctgccatgctcagtcattagccaggagcacctcatggaaggaagcatatggattccccatatgcttatatatgtgtgtgtgtgtgtgtgtgtgtatatgtatatgcatatgtgtgtgtgtatgtgtgtgtgctattctattggttctacttctctaaagaaccctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagagcacctaaacaaaagggtattaaccaattaaaataacctaaacccacacttgtccaaattgctgagcaagtgggatgggatgaaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaacttaaatgcacacatgggcagacaagtaacacaaatgagtgaagagtacagattagggcaactgggtctggtggagactgtggcaaactagagagcacacaccctatctaaggaggcagcgaggactcaattttgcaagatttgtggaatggactcccaatgttgccaaactgccactattttttaaagagaagcaggaaatccaggggtttttaaagatgtaaaatacacagtttgttgaatgctggcgactgatttttttttttttttttttgagacaagagtctcactctgttgcccaggctggagtgcagtggcatgatctcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggggttacaggtgtgagccacagcacccagccctgattttttttaatgtaaatactgtatgaacccagacaaatgttctgccaggccagtgctgcatggctcaccacgtggtggccctgagaatgggcctcatcgacctgcctctactgggagtgtaattaaccagggccccagctgctgcgctggggaatccatatgcttccttccatgaggtgctcctggctaatgactgagcatggcagggacactaaagcagacccctccccgggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaatcctgtatgggagtttgtttctcagaactgggctgacacaccatcttgcaaactctgctttcggcattcagctcacacttacttacaccctccaaactccaactatttagggctaattccattccagctcccacccgttgaatcccttccccctccccctgcttcctcctcccattctgctttcctggaaacagcatttccacttacttttgaacaatggtccttccttcactgttcattcatggagtttggatagcaccatcttctaaagctagggctgagcacatgatcaggactgactaatcaccctcttctacttccttagccacaataattcgttcagagatgggcacctgactcttacaatgcaatgagagtcagcttcttatgccagtgcttttggcaaaggtaagttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaaaaatccagcacataagtctaggagcattgaacaagggtcagattgcatggattcagattccagctccattactaactggctgtgtgaccttggacaactcaattgacctctctggccctcagtttccttatcagtaagacggaaactccaatcatatctattgcacgggatagttgtagaaattaatagatacataagtgcttagtgcaacatgtggcactcaaaatatgtgtggtatgattgttattgacacaatgtttgacccatgaatgattgtgatgccaaccccctcacagttggaaatccacctataacttttgactcccccaaaacgtagctactaatagcctattgttgaccagaagtcttaccaataacacaaacaatagacacatatgttgtattttagatgattatacactgtattcttacaataaaataagccagagaaaacaatatatgattaagaaaatcataaggaagagaaaatgtatttgttattcattaagtggaagtggatcatcataaacgtcttcatcctcattgtcttcacattgaggagactgaggaagaggaggaagaggaggaattggttttgccgtctcagaggtggcaaaaacagaaaaaaatccatgtataagtggacccatgtggttcaaatccatgttgttcaagggccaactgtatttatattacaataaatgctgttaatgttgtcactgttgacccttctattccattcccaacatcacttcctatgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacgtcaagtatgaattactttaattgccccagaagaacgcactgttgaaacatttgacttgcccagaactaattgtctgtcaaaaagatattttgcagccaagctgatctcttaattggacatctaatttaactgaaaacctttttccctgcttgttttatgctttcttctcctgtttttgccaaattctggatgctgggcactgctttcagaaataatttatcttgttattttctattataaaagtaatacatgttcattatagaaaaactgaaaaaaaaaattccacatgaagaaaaacagtggatcctagactcattgcccagaggaggactatgaacattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaagactattaacattccacatgaagaaaaacagtggctcctagactcattgcccagaggaggactatgaatattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaggactatgaacattccaaatgaagaaaaacagtggattctagactcattgcccagagaaagactatgaacattccaaatgaagaaaaacagtggatcctagactcactgcccagaggaggactatgaacattccaaatgaagaaaaacagtggatcctagactcattgcccagagaaagactatgaacattccaaatgaagaaaaacagtggatcctagactcactgcccagaggaggactatgaacatcttagcaagtctcccctcaggttgtcctagaatagatgtctctacgtagttaataaaaacatacattcaagttttgcagctttttgttccactttacattttaagttgaacgtttacacttcccattccaagatcttcagaaacatgtttagaaacagaagaatatcccaacaacagtctgtttaacctcttcccctaatgctgaactattgttgctttaagcatacattttctgtgtgtgtttcagatgtagtttccttaggaaagattctctatgctgtgcaacaattccccatgtgtctcttacatttctgcacatcttgtgtcagcatttgttctagaccgtctttataaggatgtttgtatagctaatagcattggaagatagggctaatatagtagaagacagatttatttgctgattaggattataataataatatctccggaccaggcgcagtggctcatgcctgtaatcccaccaatttgtgaggctgaggcaggcagatgacctgaggttgggagttcgagaccagcctggctaatatggtgaaacccccgtctctactacaaacacttaaaaaattagctgggtgtggtggtgggtgcctgtaatcccagctacttgggagacaggtgggagaattgcttgaacccaagaggcaggggttgcaatgagctaagatcataccactgcactccaacatgggtgtgacagagcaagactctacctcaaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccgtgtattactcatttctcacactgctaataaaaacatacccaaggctggatgtggtgtctcacacctgtaatcctaacaccttgggaggccgaggtgggcagattgcctgagctcaggagtttgagaccagcctgggcaacatggtgaaacctcatctctactaaaatacaaaaaattagccaggcattgtggtgcacacctataatcctagctactcaggaggctgaggtgggagaatcgcttgaacccgggaggtggaggttgcagtgagccaagaatgcgccactgcactccagcctgggcgacagagtgagattctgtctcaaaaaaagaaaaaaaaaaggctaggcatggctgtaatctcagcactttgggatgctgaggtgggcagatcacctgaggtcaggagttcaagaccagcctgaccaacatggagaaatcccatctgtactaaatatacaaaattagctgggtgtggtggtacatgcctgtaatcccagctactcaggaggctgaggcaggacaattgcttgaacttgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagaaaggggaagaatgagcaaaagaagaaaaagccccgtataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatatgagtcattgcctgaaatctcttttgtcctcaggaagggatagagctgcttgactcagatctctcaggtggccttagactgtaatgtcttcctttcgtgcagagctcttaccatcctaagccactacacctacctaatattctataaaaagctttttctccctacccagtgtctccaatgagctgactttcttttctggattactcttttatgtaataaaaagtagacatgagggtcaaacagaaagggaaaaaggggaatttgtttaatttctaccaagtgccaggcatagtacaaagaacatttagataaggcagaaggcattaattatttttatctacccagaacccactgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaacccaccatggtaaaaaaatacatatataaaaataaaaaagatatgaaagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaacgagatagcaatcatgtcctacataccccctttgagctcggtattcatttcttaaaactgcttgccattgccacaagtagctataaattaatctaataatgccccactggatgctataacccacacctcatagcttaacaatgtatagccaatcactcgtcaatgttatttctgaaaaccagtgagaattcctggcaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactgtctctctctctctctctctctctctctctctctctctctctctctatatatatatatatatatatatatatatatatatatatatatatatatatatgaatttgaagcccttcaaccatatggatcatatcttgaagccctaaccccctagcacctcagactgtcactgtatttggagataggggcttgaaataggtgattaagtttaaacctatttagctcatttagggtgagctctaatccaaccagactcatgttgttataggaagaggagattaggacacacagagagacaccagggatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacaggaatccatcaccacttatgacaggctctgccacatagtaggtgtgtgtgcacacaccacacacaaacatgtttagaatatgaaatccgtgaaccctactcccacactgataacagttcaggaacagttgattttccctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagtgtgtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacattctctgagaggaagatacccaaagcttcaagctcacctcaagggaaaattgagctaggtttccatgctctccacttggatctcacgcacatgaacacacatacaaccttctcctcaatattcacaagaggcctctgttgtctgcttctccagagagcggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaattttttttttttgtagagatgggggtcttgccatgttgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattataaaagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgagggccataaaggctccaagctagatggatattgggggagtgggttagcagagatgtcctaaaacaatgaattacactaatgggaagaacaaaaggtaagtctaatcacagatgtcttggttttcaagctagtcagacttcagataactgtcaaatcttcagccataaatcgaaagtggaggagaattaaagatccatccttgtttgcttacagaatttacttaatttagccactctatccttaattgatagcaacaggttttttcaaaatagtcaaagtaatctatgctttgctacataatagcaaaagtaatagccaacattcatcaacacctactatgttatacccttgacagggtttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgtgttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactctgtctcaaaaaaaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatggcagcatggttatgagcacagactctggagcaagaggtcctaggttcaaatcccagttaccctgcttatcagctaaatgacttctcagtgccttggtttctccatccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaatgccacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaaatggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttctttttttttttttttttttttttttttttgcgatggagtctcactctatcacccaggctggagtacagtggtgtgatcccggctcactgcaacctctgcctcctgaattcaagtgatgctcctgcctcagcctctcaagtagctgtgattacaggtgtgcgtcaccatgcccagctaatttttataattgtagtagagatggggtttcaccatgttgaccaggctggtcttgaactcctgacctcaagtgatcctcctgccctggcctcccaatcatggtgggattataggcttgagcccctgtgcctggcctagaaagctaacttcttaattgcaagctactttcatcaatataatgcatttgtctcactccttaaaggactcctgtcacagtggattggcaaagaacaggtcagacacaagaggcagtggagtattagtaaaatacacgtggatttggagtcagaccttcctaggtttaaatgctggttttatcgcatactagttgtatgccttcattggggtttcccaagaatcagaccctgagacaagactccaagagtaagtcatctatgtgggaggtaaatgaaacatgacacaggaaatgaaataggtcagggaggcagccagtaaagggcatattataaaacaagttactacttgggacaataactggaaaacttgctggaaaacttgctggaaaactctaggatacagtgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtacttatccacatacaccaactctcatcagttcctggtggagggatgctcccagggcaggtgttgattcctccaagacttccaagccatcatacgggtgggcaaagacagtacaaccagaaaaagacctcagaaagagggccaggcatggtggctcacgcctgtaatcccagcactttgggaggccgaggtgggcggatcaggaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaatagctgggcatggtggtgcatgcctgtaattccagctactcaggaggctgaggcaggagaattgcttgaacctgggaggtgggagctgagatcaagccactgcacttcagcctgggcgacagagtgagactccatctcaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatactcatggagcacttagtatatacccagcaatcttcaggccataggaaacagaatgttgagttaccatgacaaagtcactgtcacagagccagtggggaaagcagcctctaaacatgccacccagtaagtaacaaagatcatttcgggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaagcaggtaaccaggaaacagagtggaggggcaggcaggaatcagtgtctgcagtgcgtgctcagcatcataaagggtttgggtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggtaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcatcatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctggatgctatatgtgttatatataacatacatgttataatatatgttagatatgtatgtcatacatatcataatatataattatacattgtatattatatattatactattacatataatatataattatacattgtataattatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatatattatatataatacatagtttatatgttatataacatatataacaaattatatattatataacgtgttatataatataacatattatatattatataacgtgttatataacaagttatgtaatatacaatatgttattaaaaagatattacagaatatattaaataatgtatgttttatatattatattatatatgttttttatatattatataatatatatgttttatatatattatttttgttttttttgttttttgggggttttcttgagacagagtcttgctctattgtccaggctgcagtgcagtggtatgatcttggctcacagcaacctccgtctcccgggttcaagcaattctcctgtctcagcctcccaagtagctgggactacaggtgcccacaaccaggcctggctcatttttgtattttctttagaggcaaggtttcaccatgttggccggactggttctcaactcctgaccccaagtgccccgcccaccccatcctcctaaaatgccggaattacaggcatgagccactgcatccagcctatatatgttctttcatcatcaccacatcatctaattttacagatgagaacactgaggcttggggagatattaaatgtcttatccagattgcatgcatgtaagtgacataagcacgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgtataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttgggaaaggtttctatcattagacctctcttttcccccaaccagccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaattttttttttttttgagacagtcttgctctgtgtcccaggctggagtgcagtggcgcgatctcggcttactgcaacctccgcctcccaggttcaaacgattctcctacctcagcctcccaagaagctgggataacaggtgtgtgccaccacacctggctaatttttgtattttttagtagaaacagaatttcatcatgttggccagacttgaggtcaggtcttgaactcctgacatcaagtgatccacccgccttggcctcccaaagtgctgggattataggtgtgagccaccgtgcccggcccgaagatcacaattcttatctaactctgctattcattggctgggccaccttgggcatgtccattagctttctggttcttaggaccctcatgtctaataacaaggtctttcctacctgccccacagggctgttgtgaggaccaaatgagatcaagaatgcaaaagctctctgtcaactgtgaaacactaccaggagtaaagattcacaaggcatgagttgccacaaggcagtatagcatggtggttaggaggttaagctcttaaaccagattacttggattccagtataaccccaggatacttaactttgttttgtggtgttgttgttttgttggtgttgttgcttggtattttgtctaattttcagaaacagggtcttgctctgttgcccaggctggagtgcagtgggcatgatcatagttcactgcagccttgaactcctgggcttaagctatcctcctgcctcagcctgtggagtagctgggactagaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtattggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgctgtgattagtgctcaaaagcataaagcataactggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctgtccaaaaacgaatttaacttgccttccaaataattttactcctaatttttagctcactttctccatgaatatcatcgccattcacccagttacccaaaccaagagcctgaacaacatctttgagtccttctccatcacagcctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaattcacatggcttgggtagcttcatgagagactgggaaattagagggttttggttttgttgttgttgtttaaagcagagtctatgtcaccctaattaaaatcagtgtttcatcttttattcttcctcaaatattctgtgttaaagtcactaaagggcaccaaccaaagtaagcatcaatgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcgagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcgtattatgggcatataggagaaggtccttattgcaagaaacacacagtaaagtattgggaaatgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagagagaaagccatccacgtgaagagcaaggagacaaagttttcaggcagaaggaacatgtgagaagtagctgaacttgttttcagagttataaccctagcaatatggtggaaaataacaaataactagcaatgtggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagtgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagttgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagaaagcatttgaaacatgctacaaatttgcctgtatcctacattaaatggatttttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttttttagaaggagtttcactcttgttgcccaggctggagtgcaatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatggttgaagaagcaataacttaccccagtgcccccaaggcaagttgtctcaataatgtaacaaagctatacttaatggcaacagagcacgtttcactgatactacaccgtaaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccgtgaccctgcttttgagacccctactctctctcccttccctattatctcttggtgaatattggggaatggctcacctgaactgccccacgatttcatgcctctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggatcgaagggggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttctggccttcatctttctcctgtgctgtatgcttcctgccctggaacattggactccaagttcttcagcttttggactcttggacttacaccagtggtttgccaggggctctcaagcctttggccacagaatgaacgctgcactgctggcttccctacttttgaggttttgggactcagactggtttccttgctcctcagcttgcagatggcctattgtgggacttcaccttgtgaccgtgtgagtcagtacccctgaataaactccccttcgtatatacatttatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagaaagacataaatattttttaaaaagaatcagaaacgtatgccccaaaatgctaatatgattacatccgggtggttaatatttattttctgtttctattctctttgtgtttccccaaatttgcttgttgacagaacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaaattagctaggtgtggtggcacgtgcctgtaatcccagctactcaggaggctgagagatgagaattgcttgaacctgagtggcggaggttgcagtgagccaagatcatgccactgcactccagcctgagcaacagagcgagactctgtctcgattaaacacacaaacacacacacacacacacagttatcttgatggcagttcaggaacttgggagatgagggctgttctcctaaaaccctataagaaccctcaggtgggttatgccacccattcactaatatcccatttacgggtgaagggaaaggtggaggagaccaaccaacccaccagcagtggcctcagtctcaaataaaacttagtccctgagttagaagccaacttaaccatggagaggaaagagttcatcagatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgccttagcaaaattatgactgagacagtgaaagagatttaacttgatcaattccatcttgcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatgagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggtcacactctgtcgagaaggaacacagggagttgcggaaggcttccagaggaagtgcctgggctttgaagaatgagcaggcattaagtgggcaaaagagcatgtgcaagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaacataaggtggtgggatttcagttgaaaaggtgtccagggtcggcctcgggtcagtctatctttgggtctatcacaaacactatattaattgcccctattaatctttcattatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaataaagtcacagtgacacggcaatcaggagtggcaagggagccacagacacacatgattagacacaaaaatcatgttttcaaggcacagcccacttagagatcacagcaagatgctttatccaacctccgccggcaatcagagcttgaaaaaggagcattgtcgtcaatcaacttccctttgggcaaaagacacaggcaaaggagaagatacttcacccaccttttaataaatgtgtcttgaggagagagttggcccacatagtacagtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgggaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaacaggaaccacaaatgaaaatccttgcagagagtccaggcagataacataagtgaagaaagggaggaatgagaagcagtagggaatggtggggtctgtggtgaattggagtgcatgcctcattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaaaccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgataggtctctttccttcacaggctgagacaactccaattcaactctgaatccccaatacaggacctgcccagggaacagggctcagacatttatgctgggaaatactcagcttttggggctcagcgtccttttctgcaaaaagagttcccctcccaagaggaaatcccctaagcctaaggacaggaggtgatggaaagatggatggacgggcagatagatggatggaaaaaaatggacagttggaaacagacaaacttggtggatgagcagaaataagcctcattctcgcctaacaacgggacagcctgggggaggggtgggacacaccaaggctcccagttgacccccagcaattggacaagagagtttataaaccagcattggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcaaaagatacggttgattctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtttgagccaggagttcgaggctgcagtgagctacgatcatgacactacactccagcctgggagacacagcaagaccctatttaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacacggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccaccactccaggcctctacctgggccctttaatgccccttcctcattcctcaagagcccactggcgtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgcgttgctcacagttctggaggctgggatgtcccagatcaaggcacctgcagattcagtgcctggtgaggagggctcactctgcatcataggtggtaccttgttgccgtgtccttatatggcaaaagaggcaaaggcgcttgctcaagccccttttataaaagggggcactaatcccattcatgaaggtggattcctcatgaattagtcacttcctaagggtcccctcttactactatcacattgggtattaagttccaacatatgaattcaaggggaacaatgacattcagaccatagcaccagacgtctatctggggaagcccccaaatatttgtctttttttttttttggaggcagggtctgcctctgtcattcaggctggagtgcaatggtacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcccctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacaactggagaggggctctcacagggtccatgggaagagaccaaggaggggcatggaggagaggggagggctgagaagaccagggtgaaatggatgaggagaaggaagcagatggcagggaccctcccatctcccacatgggctcccttaggtgctactggccttgtgcaaatttgcacactcacattcacacatttctgtctgcttctctccaatcgttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaggttttggggaggaataaatggcatagcagatgggaaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctccttttttttttttttttttttttttttagagaccgggtctcattatgttgcccaggctggcctcccaaagtgctagaattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccgctagaggagccatctcagaaatgaattctgcagccccctggtgagctccagctgatgccatgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcggctctgcaggaagctgtttttgcacaaggttcttccacatttctgggaaccaggagatgtctacttcagctacaatctctcctgctcgtcccctgtcccctcgggagggtctggctcagaacagatttcactgtgggacccaagccaacctgttagccactcctaccccaggacgggtgaaacacagtcttgcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacccagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcaggcgctgcagtccagccagcctggatgacagagagagactgtctcaaaatacaaataaaataaaataaaaaaagaatgagactcttcttactgcaaaaactgacctctggggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccgtctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactatatttttttttttttttgagacagagtctcgctctgtcgccgaggctggagtgcggtggcgctatctcagctcactgcaacctctgtctcccgggttcaagtgattttcctgcctcagcctcccgagtagctgagattacaggcaccaaccaccacgcctggctaatttttgtatttttagtagaaacgcggtttcaccgtgttggccagggtggtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaatctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcccgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaacaaacaaacaaacaaacaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttttgacggagtctcgctctgtcactcaggctggagtacagtggtgcactctcggctcactgcaacctccgcctcccaggttcaagcaattctcctgcctcagcctcccaagtagctgggattacaggcgcctgccaccacgcccggctaatttttgtatttttagtagagacagggtttcaccatattggccaggctggtctcaaactcctgaccttgtgatccgcccgcctcggcctcccaaagtgctgggattacaggcatgagccaccacgcccagccctttttgctttttttttttttgaaacagggtcttgctctgtcacccaggctggagtgcagtggtgcaatcttggctcactgcaacctccacctcccaggttcaagcaattctcctgcctcagcctcttgagtagctgggagtacaggcatgtgccaccacgcccagctaatttttgcatttttagtagagatggggtttctccatgttggccaggctggtctcgaactcctgacctcaggtgatcttcccgcctcggcctcccaaagtgctggaattacaggtgtaagccaccacgcacggccctttatcagtattattattattaacttttactaaggaaagagggaggcccttggccaggccgtaggattgctggccttccagggagtgtgttacccagggaagtggcataaaattacagaattgggaagctaagaggtagctctagacatcacacctctaacctttttgatattctgttgctccatctacaaatggcatttagaatttttgttcttaaagagtcacaaatcacgtgcaggaagcttgaaaccagtcctgttaccttcctatgctctgatgccacctgggaatttgagctggtgtttcgggtaagagaacagcttataaccaggcttttcaggacaatgaagactgcctttcagtgggaagatgaacaatctgcctaagtcataagaatgatacaatggactttggggacttgggggaaagagtggaagggggtcgagggacaaaaggctacaaatatggggcagcgtatagtgttcagatgatgggtgcaccaatatctcacaaatcaccactaaagaacttactcatgtaaccaaataccacttgtaccccaataacttatgggaaaaaaatctacccaaggaataaaactaaatcgagactttaaaagcgagacattaaggaagttgactcttagctgacctggacacaggcctatcatggtaagtgctgcaggtgaacaaacagcagcaatttgacccttcttccttatacatcaaattcctttttttaaaaaattatttttgagacagagtctcgctctgttgcccaggctggagtgcagtggcacgatctcggctcactgcaacctctgcctcccaggttcaagcaattctcctgcctcagcctcccgagcagctgggattataggcacccaccagcacgtccggctaatttttgtatttttagtagagatggggtttcgccatgttggccaggctggtcttgaactcctgacttcaggtgatccacccactttggcctcccaaagtgctgggattagagacatgagccaccgcgcctggcccaatttcatttttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattaggctctccccagtttcaggggatgaatcttgagcagtctgatggagggctggcaagccattgcctaaacccggcccaccacctgcttttgtacggctcaggagctggaaatggcttttacatttttaagtagttagaaaagatcaaaagtgtaataatatctcctaacacataaaaattagatgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaagccagaggttctcaaactcagtgtccatcagaaacccccggagggcacgtttaaacatagactatgggccgggcgcagtggctcacgcctgtaattctaacactttgggaggccgagagtttgagaccagagcattgtttaagccaagagtttgagaccagactggacaacatagcaagaccctgtctctacaaaaaataaaaaaaatagctgggtgtgggggtgcacacctgtagtcctggctacatgggaggctgaggcaggaggatcgctcaagcccaggagttggaggctgcaatgcgctatgatagtgtcactgtactcctgcctgggcaacagagaccccgattctagtaaataaataaataaaaacatagatcccaccccagagtttctgatttagtaggtctgaactggggtctgagaatttgcagttcttaaaattgcctagacatggcagatgctgctggcctggggatctcgctttaagaagcactggtctaaggcaaccttgggaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcggggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcataccgcttgttaagtgcagagataggattccaactcagaggcatctggctcaagaacccacgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagagggactcaaaggtccaggcctgctcggtgtggctgcggctcaggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacactcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcatgcccttatattcccagctacttggaaggctgaggcagggaaatcacttgaacccgggaggcagaagttgcagtgagccaagatcatgccactgcactacagcctgggcgacagagcgagactctgtctcaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagaatcacttgaacctgggaggcagaggttgcagtgagccaagatcatgccactgcactccagcctgggggatagagtgagactctgtctcaaaaaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactacaggtatacagcaccacgcctcgctatttttttttttttttttttttgtagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggcatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagctggtcaggtctcgccagaaaagttcacgcaataacaaaccagccgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcagaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcgcctgcaggggcttcctgcctggaaagcctgttcctttgcccttcttctccagaggattcacgtacctcagcacatgttcgacgacaaagtcacagcactgcagggacacctcccctggagaggaacacgatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaataattacaaaaggccaggcgtggtggctcacacctgtactcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtatagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttcaattatttatttatttgtgctttcaaactgttttcttaaaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatttgagaacagagtctgccaacccctcctgatgagagactgacccctcatagccactgcaggctggaagccataagcttaaaccacttccataccatgaaagcaaaatgtatggttggcaaaaagcaaaaaaaaaaaaaaaaaacaaaaactggttactggcgagtgcagaaccacagtctgggtcgatgacaaattatccagcatgaatcttggtgtgacttaggcccttcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaactattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacgtaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccatttcggctcactgcaacctccacctcccgggtccaagagattctcctgcctcagcctcctgagtagctgggactacaggcatgcaccaccaccacacctggctaatttttatatttttagtagagacggggtttcaccatgttagcaaggctggtctcgaactcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttttgagacggagtttcactcttattgcccaggctggagtgtgatagcacgagctcggctcactgcaacctctgcctcccgggttcaagcgattctcctgcctcaccctcccaagtagctgggattacaggcatgcgccaccatgcgtggctaattttatatttttagtagaaacagggtttctccgtgttggtcaggctggtctggaactcctgacttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaaagtcagtgtgatgaaaacatgttctagataaaacagaaatgagactgggcatggtggctcatgcctggaatcccagcgccttgggaggccaaggaaggagaatcacttgaggccaggagtttgtgaccagcctgggcaacatagtgagaccgcagatctactaaaaatttaaaaattagctgggcatggtggtgcgtgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaatacaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaaagcgatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagccttttttttttctttttttgagactcttgctctgtcgcccaggttggaatgcagtggcaaaatcttggctcactgcaatcttcgcctctcaggttcaagtgactctccttcctcagcctccctagtagctgggattacaggcgtgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaacacctgggctcctctcaggctcatgcccttcccaggggtctgggaagccctgacctgcagcctgtcacctttgtttaccccccagcctccaggatattatgtgtgcaccggcgtgggatcctggaactggcaggaattgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggaggatcactggagcccaggagtttgaaacgagcctaggcaacagagtgagaccctgtctctatattaaacacacacacacacgcgcgtgcacacacacacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagctgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatgtttccatgacttccactcatttacccccaaggctgttcttaaagacgggcatgacagttatgcccattttacagatggggccctgaggctcacaagggcacgccactcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgctctgtcatcccggctggagcgcagtggtgcgatgtcagctcactgcaaattctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctgacatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcatgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctatgattaaaaacctcaggtccctcaggcaatcataccagatattgaaacaaagcaataacataaggactgcagtattcattttatttttatattatttatttattcttcattagtttcttgagattatcatccgctgagggtggaaggggagtgagcagacacactcgggaggtgtcttgagattatcatccgctgagggtggagctgagggtggaaggggagtgagcagacactcggcaggtgtcttgagattatcatccgctgagggtagagctgagggtggaaggggagtgagcagacactcgggaggtgtcttgagattatcatccgctgagggtggaaggggatagagcagacgctcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacaactggggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacctaaagaatacttttgtccatggaaaaatgaggtgggaattctaaacaaagcaagttttaaaactgtgtttcacttcaagtgtagaagtcccatcgcgtgtaatcataggactcggcagcttttgaaggtacagaggccacacaagaaccagcttagctgagcatcatttaaggccttcatttggaattgtccctgtgggtaataagttacattcactcttcactaatttacagtcagggcccatttgctattacaaatatggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcacctgtaatcccagctactcgggaggctgaggcaggggaatcatttgaacctgggaggcagaggttgcaatgagccaagatcacgtcattgcactccagcctgggtgacacagcgagactccatctcagaaaaacaaaaacaaaaacaaaaacaaaaaaaactgtacagtctgatccaaactgttgctgtattgattcctcctcttgcttactgcctgctgacttctgagatgatagcttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaatggacacctcccattgagggataaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcaaaagctcattttagttcagtgtgaaaaaccagacctcaccaattcatcacaactaactccatcggaagcagaggattgctcctcatctgactcctcctgtgtgagactgattctcagtcagaggctgatgccggaactgagaccatcagccatagagagatccttccagaatatggtgtcattaaccctgcagttcactactgcactttgccatgattcaggactggaactcttgtcatcgactttaaagatcctgaaaaggcaatctgaatgctgggcgcatctattgaattagaaatgatgggaatggctcctaagtcagggtgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcgtgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccctggcctttgtagggactgagcctgcacagacgacctcaattgcagcctgtatggaggacccctgaccatcccccagaagtagactcccatctcttctgcagcaagataacatgctactaggtctcagttcattgctaaatattttttaaaaagtatctcacatttaacaaaaaaagatcagtcatatggcagcaaaatacaatgtaatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaattggccgaatgtggtggcacacacctgtaatccaagctactcgggaagccgaggcagaattgcttcaaactgggaggcagaggttgcagtgagccaagattgcaccatagcactccagcctgggcgacagagcgagactctatctcaaaattaaaaaaaaaaaaaaaagcctgggtgtggtggctcatgcctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccgtctcaggaaaaaaaaaaaaagagagagagaaaggaaaaccaatgccagtactagcaactcctcttcccctgaaaaaatgacaaacaagattgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctaggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccaagctactcgggaggctgaggcagagaaccgtttgaagctgggaggtggaggttgcagtgagccgagatcacaccactgcactccagcctgagtgacagaatgagactctgtcacacacacacacacacacacacacacaaacacacaagaatgacatgaggctggcatggtggctcactcctgtaatcccagtactttgggaggccgaggcaggcggaacacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaataggccaggtgcggtagctcacgcctgtaatcccagcactttgggaggccgaggcgggtgaatcacggtccagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaatgacatgaatatacttcacacaactgaactgtacacttcaacatggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaatgcaaaacattctcactaatgattgaattcccaccaagatttccatattatcacagtatgcttttaatcttcgaagatattaaatatttgttctcatcatagctaaaatgcaacgcaaatcccatctgagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatgacacccatgatgtccctgcttaggaggtaatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtcgtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaaagcttcctccaatttataccaaaaattctctgttcaggactaagtggcatagagaatgttaaatgtgcctagatatcttcataactcatatattttctgttttctacatatcttgaaaggcagtgccaaatgacgtgtaattatctaggcagtaaaactgaaacatacttcctcttcccttgaatatcaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatacggatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaattttttttttttttttgagacagagttctgctccactcagtcgcccaggctggagtgcagtggtgcaatctcggctcactgcaacctccagctcctgggctcaagccattctcctgcctcagcctcccgagcagctgagattaccggtctctgccaccatgcctgactaatttttgtatttttagtagagatgaggtttcaccatgttggccagtctggccttgaactcctgacaggcgatctgcctgcctcggcctcccaaagtgctgggattacaggtgtgagccaccgtgcccagccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagtgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctgggaatacaggtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaatacaatgaagagattatttcattcacaaataagtatcgaattttagttcttaaaaagtaacaaggtgggccgggcgtggtggctcacgcctgcaatcccagcactttgggaagccgaggtgggtggaccacgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagtgtgggatttctctaagattgttgatattaattccattagactcttatgtgagtgaagacaaagacttcccctgagtaagttcagacagcttgtgataacatttctacatcaattcctcaggatttaactatatattcttgaaaacatctcaattttaaatgtttctttcaagatggtgaattaaacagagatagcccttcaacaggttgaactcagcatatgctgagtctgaaatggaaatgatggagttagagaagcatacaacaatggtaatgatttcagaaatacggtgttgagcagaataaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatagaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcggatcacgaggtcaagacatggagactatcctggcgaacatggtgaaacccagtctctactaaaaatacaaaaattagccaggcgtggtggcctactaaaaatacaaaaattagccaggcgtggtggtctactaaaaatacaaaaattagccaggcattgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaaaaagtcatcaaaccagatgacacaaatcaaatgacatttcactttgttttggtccgttttgtttgttggagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccaacgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggctccctgaggcagccaggacagaggtggaggtggcttagggcagggcggagggaaggggacggggaccggggccggatctgagttggggagggggaggggagggggaggggaaggggaaggggaggggaaggggagaagtaagggaagggaaaggaggagaagggggctgttggggaggaggaggaggagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagtgcccgcatcatcccaatgacccctcccccatctcagtcccccacgctcctcccaaggccaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacaaccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgcgtgatctcaaatcacccctaacccacctagacattttaacatccgaaaccgagtgatgatgtccttatctatattatcttactgcccgtgtgtgtggactttaaattctgaacccaaatgagggggagaaaaccaagctgactttcatgactggcctctcagggatgtccaaggaatctgtgcatttcaagaaacaaagctcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaagcactgctttaaatccctttaccatttactatgacataaggttattgtaaacaggaaatattctattgatgctacaaatggaaagccaatgcctttaccataaatagaaaaacaaccctaagaagcaagcaaaacaaaagaaaacaggggctgggtgtggtggctcacacctgtaatcccaccactttgggaggccgaggtgggcggatcacaaggtcaggagttccagaccagcctggccaatatggtgaaaccctgtctctaataaaatacaaaaattagccgggtgtggtggtgggcacctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggggttgacacgagcctggccaatatggtgaaaccccatctctactaagaatacaaaaattagctgggcatggtggcgcatacctgtagtcccagctactcagaggctgaggcagaggaattgcttgaacccgggagacggaggttgcagtgagccgagattgtgccattgcactccagcctgggggacagagtgaaactctgtctcaaaaaaaaataaaaaatatatatatatgtgtgtgtgtgtgtctgtgtgtgtgtgtgtgtgtgtgtgtgtatctctataaatctcaaaaataaaagatcatttttgagattatcattttaaaagacaagataatgttcaacttaatgaataatttaattattactactggactttttgtagactgcacagagcattcaaaacaaatgaaggagaataaaaaatatgtattacatgttgtaaaataaatgtgatgtggttaattcttttattcaaaattatagaacatatatatgtactgtagaatgtatttcttattatgagtcatgttaaaaagtagtttagaagctgttgatttgaatttccttttcaaattttgcaggataatttttttttttttttgacagagtctcgctctgtcgtacagtctggagtgcaatggcgtgatctcggcccactaaaacctccacctcctgaatttcagcaattctcctgtctcagcctcctgagtagctggaactacaggctgacaccaccatgcccggctaatttttgtatttttagtagggacgaggttttgccatattggtcaggctggtctcgaagtcctggcctctggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgagactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacgtgctgctgcagctccttggtgagctggccctggtcatgggacaggaaccgtggggtcaggacaatagagagcttcaccatttgcagaatgagaacaggggctcatgatgagtgccaacctattagacaattttaaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttcggtcataattagtgggatccatttcactattattggatatacagttctgtgcctgaaacctacaaaaaaagaaaatgttaagtctaaaaagcattagtgatttctcatttttacattactaattataaccctgtttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataacgagaatccttagctcattcggttgtggtgaggggtgaatgatttggcacacaggaggggcttgttaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggcttctgctgcatctgccttctcagtgttcacctaaggacttttgtattttcctcctcacatccccacagaaggggttcaggctgccgaacacagctgggtgatgccagggcagtggccacctgtgccagccctgtgaggtagctggaggatcattgctccttccttctcaggctctgggcagatgccagggctggggtgacccatgccctcaagtttcttgctttggagggccacattttcccttggcaaagagggtaaaggtcacaggatgccggagagctgtgacttctctgtgccctgggcccaaactatgaagacctgacacactatgctaaaagtccaaggctgggtgctccccagagcttcttgcctcaccacttctgctgagggaggaatgaatactatgtcctcccagagctttgggagcttgtagcaagcagcctccccagcgcaaaatctcttggaaacctctaactgtgtcggaaacattagtgcaaatgttgcatcctatttcccatatgtccgcatgttttaggaaaaaaccctcaatttcctaaatatgcaagaaaaattggtattgtaggacaatgtgactttttaaaaaatgttatttaaacatcttccccacctccttttctgccctccaagactgccaaatacttgttgaacaaatattattaaatgcctactacgtgccagccatgattcatggtcttggggacacagcagagaacgaactgacaggattcctctcttatgtaactcacattcttatatgataatgataagggttaacattaattaagctgtcactacgtgttagtcacggtgcagtcattcccacacattattacacttaaacctgctagcaagcttgcaaggtagttagttgtttttcctttaaaaactgagtctcagaatgatgaagcactttgtccaatgtcacacagctagtaagtgtggagaccttgcatccaatcaatgcccgtctcattctaaacaccacgttatgtgttctccagcccatggagaataattttaacacagtcaatgaaatttctacacaacaatgttcttgtctcaagtccaagaaagccataatactggctttctggtgagtaaagatgccattctcatgtgtaatcaggtggcaaatggagatatgaccaaagtaaccctttgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaatgaacaccctttttaatagtgacctgtgattctgttttgatcaagtgttttcaaacttgacatctttgatgggtttctccagtgtcaaaatcctaaatcaggtctttttggcttaaaattaactttgggatttttccactgcgtcccttcgggagtctgaagaatgcatctctcatcttgtagagatattaagtgattcgatttatttggtagattatatgggcgggcattgtcaaatgtggtgatactgcatgggagggcactgtcaagtgaggtgacattagatctcatctcagttatatttatgggtatgttgttgatatacatgttccaaaaattacatacatttatacaaatttaatatgttatgatttgtaattttgatagttatactaaatatttgttaaagttatatttgtataaacatgttatgaatggctgggcaccgtcactcatgcctgtaatcccagcactttcggagacaaaggcaggtggatcacctgaggttgggagttcgagaccagcctgactaatagggtgaaaccctgtctccactaaaaatacaaaaattcgccatgcctggtggcacatgcctgtagtctcagctactcgggaggctgagacaggaaaattgcttgaacacaggaggcggaggatgcagtgagtcgagatcatgccactgcactcccacctgggcaacagaggtagaatctatctaaaaaaaaagttattaattatttctgaagattatatgaaatttataaaagtctggtggtcctgatgtgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcttgtttttgagacacagtctggctctgtcgcttaagctggagtgcaatggtgggatcttggctcactgcaagctctgcctcctgggttcacgccattctcctgcctcagcctcccaagtagctgggactacaggtgcctgccaccacgcccagctaattttttgtatttttagtagagacggggtttcactgtgttagccaggatggtctcaatctcctgacctcgtgctctgcccgcctcggcctcccaaagtgctgggattacagatgtgagccaccgcgcccagcttaatttttgcatttttagtacagaggaggtttcaccatgttggccaggatggtctcgatctactgaccttgtaatctgcctgcctcggcctcccaaagtgctgggattacaggcatgagccactgcaactgaatttttttttgtttgtttgtttgagacagagactcactctgtcacccaggctggagtgcagtggcatgattttggctcactgcaacctccacctcctgagttcaaacaattatcctgcctcgtccttcggagtacctgggattacaggtgagtgccaccgtgcctggctcatttttgtatttttactagagacagcgtttcatcatgttggccaggctggtctcaaatcctggcctcaactgatccactctcattggccttccaaggtgctgggattataggcatgagacaccacacctggctcagtaagtacattttttattatcaaaaaagagtagtgtatgattggcttattctgtgtagaatgtattttatcgatggcttctatttttataatttctgagttaagtaatttttaatgaatgctttttagtttggggcagattcagttgactaaagcacctcatttcccagatacatgaaataaaatatttggcttcttttccaatttcacactgatgttattttgtgaaaatcagtgctttaagataaatctttatactttaaggtaaacatgagaaacttgatctaatatttaatatttattcagttctacactttattaacttctacaccagcagatttaaaaattatgtaactatctcaagaagtttcacttgggtgtaacggttcacgcttgtaatcccagcactttgggaggctgaggtgggaggattgcttaagacaaggagtttgagaccagcttgggcaatacagcaagatcccatctctattttaaagaaaagtttcactttgggaggccaaggcaggcggatcacaaggtcaggagatcgagaccatcctggctaacatggcaaaaccccatctctactaaaaatacaaaaaattagccaggcgtggtggtgggcacctgtagttccagctactcgggaggctgaggaagaagaatagcgtgaacccaggaggcagagtttgcagtgagctgagattgtgccactgcactccagcctgggcgacagagcgagactccgtctcaaaaaaaaaaaaaaaaagtttcagcaaattccacctaagaattccaccagagttctgttgtctccaatgtcatgttccacagatttcaagttgtgaagccctgaactgttaatttatcttgagaatgtacatttaagcttaatttaagactatatacctaaaaattgagcatataatttgtataatttgtttatgtaagtttttgtaagtcataagtatgtagtttccaagtatataatttatctgaatgtaataggcattaatatattttacattattgggaccataatacagaaatttctaaatggtttgtaaaataacttgttatttgcaatgttgtaaaagtagttaatacaatggaaaaactcataataagaagatacattttaacatcaagaagtttacccaaggtaattatgaatactacctggcaaactttacagaagctgtggtatcacttttatgatagaagaatagtgtttgcattttgtgtaaaagtacttggggctgggagtagtggctcatgtctataatcccagtgctttgggaggtgaaggcaggtggatcatctgagcccaggagtttgagaccagcctaggcaacatggcaagagcctgtctctccaaaacctatgaaaattagccaagcatggtggtgtgagcctgtagtcccagctacttgggagactcatgcaggaggatctcttgagcccaagaggcagaagatgaataaataaatggatgccactgaatgagatgaggtctctcttgaaggagagagaaaaagagatttaaatagtaacaattataataaggctgggcgcggtggctcacgcttgtaatcccagaactttgggaggccaaggcaggaggatcggttgaggtcacgagtttaagaccagcatggccaacacggtgaaacaatgtctctattaaaaatagaaaattagccagacatggtagtgcgttgcctgtggtctcagctactcaggtggctgagacaggagaatcgcttgaacctgggaggaataggttgtagtgagccgataaatataaaaagtattagagtcctaacagaggaaagtttccactgatcaccttttagctttgaacaatgcagaagcatttgcccagtttacttgtaattaaaaatcatgcatcattcacaatttatcagtcttttttgtttgtacaaaaactaatataagttattctcttttgtctgtattgtgactggtttggtgagagggaattaggccactcgagagtttgtgtgtgtttaaaattttctggccaggcacggtggctcatgcctgtaatcccagcacattcggaggctgaggcaggggtatcacctgaggtcaggagttctagaccagcctgaccaacatggagaaacccccatctctactaaaaatacaaaattagctgggcgtggtggtacgtgcctgtaatcccagctactcgggaggctgaggcaggagaattgcttgaacctgggaggcggaggttgtggtgagttgagatcacgccattgcactccagcctgggcaataagagtgaaactctgtctcaaataaataaataaataaatacataaactatcacagcataaagtaggagggatatttcattactgtctagttaaactggttaatgcggaaaggaagtctggaaattccagttttaaagtaaaattttggacattgtaggattgattatttggcatagctgtgatgtttgttgctgcattatggttttgttggcagggcagcctttaaggacctgtatattttcttctagactctatatattccccgtcagtattagttgcatggtcaaactggcaaattttaccataggtataaataatagagaatgtggaagaatagtgaatagtgtcagagatagttaaaggtccatacagaagtagagaaggtaataagtaatagtggcttggactaaatatttgttgaataaattttttaaaaaacagcctacctaaaatttgtgttgaagatatgaatgaatgaagtttccgcacccttatgtggagccctgataagtaagcaaaaataaggaagggtccccaggttggggagagccccaagttgaggagaataatgaacaattattgtatgaacaattgttagagacagctaatcacaaacaacctgtgggtacaatgacctcattccacatgtagcacccttaagcatgaccctgtaaaactttcctccagcccttgcctctttgcaggtagctccttctctgctgagctgcccactgcaacatattttcataatttctctaataaatctgcctttctttacctacaactatcttggtaaatagctttaccacctgcaaaactgaccctagttagttgctacccgatatggtttggctgcgcccccacccaaatttcatcttgaattgtagctcccatcatccccatgtgtcgtgggagggacctggtaggaggtaatggaatcatgggggcaggtttttcccatactgttctcgtgatagggaatacatctcactaaatctggtggttttataaagggcagtttccctgcacatgctctcttacctgctgccatgtaagacgtacctttgctccttctttgccttccaccatgattctgaggcctccccagccttgtggaactgtgagtacattaaacctctttttctttataaattacccagtctcaagtatttcttcatagcagtatgaaaagtaactaatacactacccgagacaccttaggagatttgtaacagctgtaatgccaggtccaccatatttttagcataaagcaaatgtttacccatgatatgactgcacaggctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggtaacatggaaaaacacagtctctacaaaaaatacaaaaattagctgagcgtggtggcacacacctgtagtcccagcaccttgggaggctgaggcaggagtatctcttgaacccaggaggtggaggccgcagtgagcagtgatcatgtcagaggcatgtgaaccagagcaactccatcttaaataggagctgggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagtgacaagagtgacctcccgtcatcctcactgctacactcctaccagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcctggctgctctgtctgtggagtagccattcttttattcctttactttcttttttttttttttttttgagatggagtctccctctgtcacccaggctggaatgcagtggcgtgatctcggctcactgcaagcttcacctcccgggttcacgccattctcctgcctcagcctccagagtagctgggactacaggcgcccgccaccacacctggctaatctttttgtatttttagtagagacggggtttcactgtgttaacaaggatggtcttgatctcctgacctcgtgatccacctgtctcagcctcccaaagtgctggggttacaggcgtgagccaccgtgcccctcctcctttacttttttaataaacttgctttcacttcacactgcaggatcaccctgaattctttcttgcacaagatccaagaaccttctcttggggtctggattgggacccctttcctgtaactatcatgccactgcactccagcctgggcaacagagcaaggccctgtctcaaaacaaaaaaaactaatatgacttaatacattcattttggagggcaagtctctcaaaatgggcctttcactgggggaaaatggtaaaaatactccctggtaattcaagaattgcagactcctgagatgctgctcatattagctgaacacttaccaatacttcacttttttccatatatactcaaggaacaagtgctatttaaagtgtttcactctgctgtgctaggtgcaagactataaagaggtgtgaggatcaacacttttatgaaaaccaacgtcattctgaatgtagtttcagatgctagtgcaaaggaagttcttggtatacggaaaaagtattcaacaataaattaggcatggttgcttccattttctgcctcacacacttttttttcgtggttaaagtgataaaacgtctatgatattttagattggcagttgcaaactagtggtcctcagcgggttttttatgacacctacaaggtttgaagactttgatttcatattaaaaatctgggtttcagtctgggtgtggtgctgcacttctgtaatcccagcactttgggaggctaaggtgggtggatcacctgaggtcaggagttcgagaccagcctggccaacatgatgaaactctgtctctactaaaaatacaaaaattagccaggcatggtggcatgtgcctgtaatcccagctactcaggaggctgaggcaggagaattgcttgaaccagggaggtggaggttgcagtgagccaagatcgcaccactgcactcaagcttaggcaatagagcaagactccatctcaaaaaatgaataaataaataaataaaatctgggtttcaggccagctgtggtggtgcactcctgcaatcccagcactttgggaggctgagatgggcagacagcttgaggtcaggaattccagactagcctgggcaacatggcgaaaccccatgtctacaaataatacaaaaaaattagctgggtgtagtggagtgtgcctgtaatctcagcaacttgggaggctgaagtgagaggattgcttgagcctgggaggttgaggttacagtgagccaagatcgcactcctacactccaacctgggcaacagagtcagaactactcttaaaaaaaaaaaaaaaaaaaaaaaaaaaaaaattctgggtttctggcatctcaaaaaaaaaaaaaaaaaggaaaggtcagggcagctacagtcctctattaagcaatgtgccacagcaggggtccctaattcctgggccatggacctgtactggtctgtggcctgttaggaactgggccacagagcaggaggtgaatggtgggtaacaactgaagcttcgtctgtatttctggccgctccccattgtttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattagcatcctgtgccccatcccttgccgcctgtggaaaaattgtcttccgcaaagccagtccctggtgccaaaaatgttggggactgctgtgctttagaatctgcctggaatctgcagcctctattatatagttccctatagactttgcttcctaccatcttacattctgccttataggcatttgtgtttgcaactcttgcttttgtcagtatgctacgctggtgacattgaccaaattgaccacacattaattataagcttagttggtgatgacctcaatggaataacatgacataagtattgtgacactacttcttgcatgtatctgcaggtggaattgtaaacctggtggtccgagatggtctaattcgatcttcctatgtatctccttatattaatagtggtaacatttgtggtggtgattcagcgtttcaatgcctcttctcatggcaacaacaaacgttttccgtctgaatcaacattaacctagatgttactgcggatcagaattagactctacattttcaaccacagaaatattgggcagtaaacatttttcttaatattgattgcctacataggttgtgtaattagcatatgtttatagttctatgatttgtgcatggctgctgcagagctggagggggtaaagcaacagtgttttctcagttgtgcgagcagcattacattataatgaataggtaatattaaactgggctgataagagttgcaaaagactactttaatgttcatatggaaccaaaaaagagcccgcattgccaagacaatcctaagcccaaagaacaaagctggaggcatcatgctacctgacttcaaactatactacaaggctacagtaaccaaaacagcatggtactggtaccaaaacagacatatagaccaatggaacagaacagagccctcagaaataataccacacatctacaactatctgatctttgacaaacctgacaaaaacaagaaatggggaaaggattccctatttaatagatggtgctgggaaaactggctagccatatgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtgaacaggcaacatacagaatgggagaaaactttcataatctacccatctgacaaagggctaatatccagaatctacaaagaacttaaacaaatttacaagaaaaaatcaaacaaccccatcaaaaagtgggcaaaggatatgaacagacacttctcaaaagaagacatttatgcagccaacagacacgtgaaaaaaatgctcatcatcactggccatcagagaaatgcaaatcaaaaccacaatgagataccatctcatgccagttagaatggcaatcattaaaaagtcaggaaacaacaggtgctggagaggatgtggagaaataggaacacttttacactgttgatgggactgtaaactagttcaaccattgtggaagacagtgtggcgattcctcaaggatctagaactagaaataccatttgacccagccatcctattgctgggtatatacccaaaggattataaatcatgccgctataaagacacatgcacacatatgtttattgcggcactattcacaatagcaaagacttggaaccaacccaaatgtccatcaatgatagactggattaagaaaacgtggcaattatacaccatggaatactacgcagccataaaaacggatgagttcatgtcctttgtaggaacatggatgaagctggaaaccatcattctgagcaaactatcatcaggacagaaaatcaaacaccgcatgttctcactcataggtgggaattgaacaaagagaacacctggacacagggcggggaacatcacaccctggggcctgtcatggggtgggggaagcggggagggatagcattaggagatatacctgatgtaaatgacgagttaatgggtgcagcacaccaacatggcacatgtatacatatgtaacaaacctgcacgttgtgcacatgtaccctagaacttaaagtgtaataaaaataaataaataaatagggctgatgaatcatattacagtaatccaatatttcccttgtaaagtccctgaggtttacagaaggaaatcttttctaataacaaaaagagtgaggcatgtgctttggtctttatttcctagttatacgatcctgggtaaggagctcaacttttctctgccaaaattaaatgaggattaaatgagatcatatatgtgaagttgtgaaagacagtacctggcacatagcaggatcaatcaatgttagtatctctaaaatagagattgagtctgaagatccacaaagtggtagaaccgatcttaagattcccaaataatagaattgtgctttatttgcctaagtagtatggtattacttattgtatgcccaggggatcttttttttttaaataatatttatttatttattttgagacagagtctcactctgtcccccaagctggagtgcagtggcaccattttggctcactgcaacctctacctacccagttcaagcaattctcctgcctcagcctccggagtagctgggattacaggtgcacaccaccatgcccggctgatttttgtatatttagtagagacagggttttgccatgttggccagattggtcttaaactcctgacctcaggtgatccagctccctcagcctgccacagtgctgggattacaggtgtaagccaccgcacccagacctaatgttttattttttggtagagatgaggtcttactatgtggcccaggctggtcttgaattcctggacctaagtgatcctcccaccttgacctcccaaattgttgggattacaggcatgagccaccgcgcccagttcccttcttaaatagttttaagggggagaagaaagaaaaagactgattttcttcccttccactaccaaaacaggcaaaacacaccagaacactttgcttagcatttcttttcttttctttttttgagaaagagtctccctctgtcagccagggtggagtgcagtggggcgatcttggctcacttcaagctccacctcctgggttcaggccattctcctgcctcagcctcccgagtagctgggactacaggtgcccgccaccacgcccggctaattttttgtatttttagtagagacgggatttcaccgtgttagccaggatggtctggatctcctgacctcgtgatccgcccgccttggcctcccaaagtgctggtattacaggcgtgagccaccgtgcctggccgtcccatcattttttaagataaattcacataccataaaacttaccattttattttctctctcttttctctttcttcctttctttctttcttttttttttttttttttgcaggctggagtgcagtggccctatcgtggctcactgcaaccttgaattcctgggctcaagagatcctcccacctcagcctcccgagtagcagtagctgagactatcagtgcgcaccaccaagcctgagtaattacaatacttttttctttttccttttcttgattttccgtagagatggggtcttcctattttgtccaggctgatctggaactcctgccctcaaaggatcctcctgtctaattctcccaaagtgctgggattacaggcatgtgccaccgcgcctggccaaatgcaccccctttttttaagtgtacaattcaatggtttttaatagattcacaaagtcatggaaccatcacacctatctaatttcaaaatgttttcatcactccaaaaaataaccccatatgggaggccgaggcgggcaggtcactcgagaccagcctggccaacatattgaaaccccgtctccactaaagatacaaaaattagtcgggcgtgatggcgcacgcgtgtagtcccagctgctcgggaggctgaggcaggagaatcgcttgaacccgggaggcggaggttgcagtgagcccagatcgccccactgcactccagcctgggcgacagagcgagactccgtctcaaaaatatctaattaattaataaaaataaaataaataaataaataaccccatgccttctgcctctgtggctttgcctgttctcggtattttgtgtcaatggacccatgcatgggggtgggccgggcacctttcaaacgttcagcccccaggacggcccgtggcctccggattggacggcgcgagctgggtgtgtgtgggtcgctcaatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtgaggggccgggaggggacctggggggtgggacccagtattgggggactggaggctgggactcggggatcaagcggctggagggagggcgctgcaggagcctggggacccgggcaggagccggggctctgagaccggagctgcttcagaggcctgaagggccagggcaaaggctagaggctggggtgtttgattgcgaaaatttgcaggaggcactggctggggagccgagaaattggggagccagaggtccaccaggtcaggaatttagaggactagggtcggggctcagactctggggttgggtgtagaccaaggctggaggtaggcagggctgcggaggtctttgccccctgaaaaaggcccacgggaaaataaaggagatcccagttcaaggccgtagcagctgcaatgaccgtgaaccagtcgtgggacagggaaggaaccgacctgctgttcagaaaatccacgcctggggccccggggccaacacaggaacaaaatgcaaggggatcagtgaccctgaggggcagagcaggtggaatctgaggttgggcctggatcttcagcaaattcatgcccaggggcctagtcctggtttggtaacaagattttcccctggggtctcacggaaaacatcaagggaccttggatccttgccatggaggactatatacctgtgagggttcagggaaccctctccttagaaaatccgacccgggcctggggtgtgggggacaggggcttgactgtggaaaccttctctactgcatacaataagaacaatggaaatggtacctgaaaaataccggggttcattcccttaacgagtcacaaaggactccaccaagaggcggattttgatcaatgggagttttacttggcacaagaaaggaagacactgggcgtattctcccaagtagtgtgtcccccagagaaagagacaggagggttttataaggtgatggagaaaggagagggtgcatgactgcatgtagagtaggggtcccagtgagtcatgatgctagcacataggctgcataggttgcataggttatagtcgtgaagctatagcttctcccggggtgaagactttagcatggtaatgaggagagttaacttgggttcatctacaagtaacctggggtcacttaggagctgatttaaacaaacagggtgacctcattccgcccagggttggggaagaacaggttgaggtcaggaggctgtaaaacaggctgatcgctcaagttggttaaattcttgtcatctttggagatcccccgtctgctcacaggaggggccctgtggcctctagcatcattgcgatttctagagccttgaaggggatggggtgggtaactggggagaaaatctctacgggtctcaagcctgaccttgggattggggatcacagatctccccccaaatgggagggaacttctcctaagggctgttggtgctttctaaaccaggttgaagtcagacaagccaccatcttgaagaaacctaccctgccccgtgtgccttatttttaagagttggattcacttcctttccctacagaccccaccagaaacacaaaccacctggttgcctgttgtcattgcggccaactacatggctgacggggtcagtgggtcaggagagcaggcagcctgagagctagggcctcctgttttatcagaaggtctgtgcctgtgcccggtgtgtgatttgcagactagatttgcaaacagcttcctagcacctgttacaggaacctggtacactggtgaaggggtaggggaccagaatgctatttaatcctcaaacaactagtgagattgttctctttttcttcttttttttttgagacagagtctcgctttattgcccagcctggagtgtgcagtggcccagtctcagctcactgaaacctgcatctccaggttcaagcaattctcctgcctcagcctaccaagtagctgggattacagatgcacaccaccatgcccacctaatttttgcatttttaatggagatggggtttcaccatgttggccaggctggtctcgaactcctgacctcaagtgatctgcccatttggcctcccaaagtgctgggattacaggcgtgagccctcacacttgagattgttcttaatactctcatattacaaatgaggaaactgagtctcaaaggggttctgtgactcacccaaagacaacacaatccaggcacttgatgctctcatggtgggaagtttgacagtttgcctgaaactgaaagatgctgagttactaacaagacttgaacctaagtccaggccaagctctctgatacagattcctggccagattgcagctttgctttggtcttcagtttttcttttctttctttctttttttttttttttgaaacggagtcttgctcttgttgcccaggctggagtgcaatgacacaatctcagctcactgcaacctcagcctcccaggttcaagcgattctcctgcctctcctgcccctcctgagtagctgggattacaggtgcccgccaccacgcctggctaatttttgtgtttttagtagagacggggtttcgccaagttggccaggctggtctcgaactcctgacctcaagtgacttgcccacctcggtctcccaaagtgctgggattacaggtgtgagccacctcacctggccggttttcagtttttctggttcagtttcccttacctcacatttcaatgaaaggggaagtggaaggggatagagtggaggtttgcgtaaggctttacatggaaattgcaggaatcaattgatctttgtgctggggctaccttggggaaccagagtcgtaacagattaacaactctggcttgggaatcagacacctgggttgaactctgtccgctattaacctctctaagctcttttcctcctttgtaactctacccaccttagcgaattgtaaggaggggcacatgaaatgaggcacgtaaactacatagcatttaattaatgctgggtaagtggaacacagtattaccaatattttgctgggtcatgtaagaatcgtctgtaattaactaataaagctcttatattccctccctcctaatcagggattggaaagaatttttaaagtactctcagttttacaaccttcctaaaataggagagctttgccttgctacctgaatttattgttacttttttccttttctttttctgagacagggtctcactctattccccaggctgaagtgcagtgatgtgatcacagctcattgcagcctcgacctcctgggctcaagcgatcctcccacctctgcctctggagtagctgggactacaggcacgcacccctatacctggctggtttttaaatagttttgtagagacaaggtcttgatatattgcccaggctgtgaatttctcttcagggatattgaagatcaaagtgtttttaggaagggtgaattggtgttccactttcaaattttgaatagggtaatactgatggaaaatttgtagtcgccagagtatttgggtccactggcctttttttatttttatttttttgagatagagtcttgctctgtcacccagtcaggagcacagtggtgcagtctcggctcacctcaacctccaaatcctgggttgtgtagtggtacaatcttggctcaccgcaacctccacttcctgggttcaagcgatccttctgcctcagcctctcaagaacctggaattacaggcatatgccaccatgcctggctaattttgtatttttagtagagacggggtttctccatgttggtcaggctggtcttgaactcccaacctcaggtgatctgccagatcagcctcccaaagtgctgggattacaggcatgagccacgcgcccagcccactagcttttttaaaaagacagaaattaaaatttcaaaatgttcaaatgttcaacatttcacaaaatgtttggaaggtagagaaagtaaccaatagacccactattgtaacctgattgtttttgtgaattgttagtttttgaaaaaataatcgttctgctataatttttatactctgctattctcacttcgtatttatcattcctttaaaatttatctagttttagagtggagattatgttttcttttttttttttttttttgtttgagacagggtcttgctgtgttgcccaggctggagtgcagtggcatgatcacagctcactgcagcctccacctcccaggctcaagcgatcctcccacctcagcctcctgagtagctatgactacaggcacgctactacacctggctaatttttgtattttttgtagagatgaggttttgccctgttgcccaggctggtctcttaactcctggactcaagcaatctgcctgcctcggcctcccgttacaggcttgagccacggcgcctgtctatgttctcttttcactgttgggtcagagggtcatattgttggatgatagtgatggttactttgcattttggaatgggaaacttaaacatgaactgttatacggtactctactgaatcttttaaaattttttttgggttttgcaaataggtatgagcattctccaaggaaaggatgacatatttttggacctgaaacagaaattctggaatacctatctggtaagataggcgtttgaaaatgtaatcactatatttttgtgtatatatgtatatatatgtgtataaaaatatatgttttgtgtttatatttataaagattaaaaaatcttttaattgacacatataagtacatattttcatatacatgtgataatttgacacgtgtttaatcacatcaggatttttttgtatgtgtgtgtgtatatatatatatatatatatatatatatttttttttttttttttttttttttaattaaaaaaacctttttcgagacagggtctcattctggcacccaggctggaatgcagtggcatggtcatggctcactgcagcctggacctcctgagctcaagcgatcctcccacctcagcctcctgagtagctgagactacaggcatgtgccaccacacccagctaattatttttaaattttttggtagagacagagtctcactatgtagcacaggctggccttgaactcctgtgctccagtgattctcccacctcaacattaagtacatttttattaaactattcctaaattagagctccagtttggttgacagaagggtccaatattttgacatagaaatcttaaagttattttgatagatgtatgaggagaggttttaagagtatctgtacttctcatgaactggaaagaaataatgtctctgggcccggtgcagtggctcatgcctgtaatcccaacacttgggaggctgaggcaggcggatcacttgacgttaggagtttgaaaccagcctggccaatatggtgaaaccctgtttctactaaaaatacaaaaaatagtcaggcacggtggtgcatgtctgtaatcccagctactcagtaggccgaggcaggagaatcacttgaacctggagacaggttgcagtgagccgagatcgcaccactgcactccagcctgggcaatacagcaagactccatctcaaaaaagagaaaaaagaagaaaagaaaagaaataatatctctgaattttagtccatgttctcagtgatttctgactttattatattaactcttagtaatgatcacaatttactttgtaaattttgcagccaaagggacaacaatttattctgtaaatttgggattctatttgcaaaatagagattatagattgtgagtggcttaatggaatcattcccacattcagagccaatgttttcaggtgagcatcctgcggagtcctggtgaaaagaactttaacatcacaaaggtattgatagagaaggagaaggtttccaagggttattccaaggtttgaagcaaatcagcatttttactgtttgctcggcacaaatatatacagtccagtccaatacatatttattcattgattcagttaatatttattgaacagtgtccttaaggcctggcaaaatcagggatggttttcatctctgccctagagcatgtttgattgcattcatcacaaggaggtaaatctttgggattacagaatgttcgcagactggcctagggcttcacatgttcttccttccctatcaaaagcagtgttgagccacacccagctattacctccacagcttctagcatcatctgttggatggtaccaggcccctgagccagcattacttgatggctagaggcagaggatggagaggtttgaagtcagaggcttcccctgagcctctatactcaggaacagtaactataagtgtgttcagaactcttgtgatttctcttagggcagaaattgaggaccccatggtgacaaccaaatgtgattttcttctggttttgttttttgtttgtgtgttttggtttttttgtttgtttgtttgttttttgagacggagtcttgctccgtagcctaggctggagtgcagtggcactctgcaacctttgcctcccgggttcaagcaattctcaattctcctgcctcagcctcctgagtagctggaattacagacttgcaccaccacatccagctaattttttgtatttttcagtagagatagggtttcaccatgttggccaggttggtcttgaactcctgacctcaggtgatccgcctccctcagcctcccaaagttctgggattacaggcatgaatcaccatacccagccacttcttctgttttactttagaaaaaggaacaagtttttccattatgttgtaaagtctatggagatatgtacatctaacttttttttttttttttttaaagagcaaggaccggaggcagtagctcatgcctgtgatcccaacactttgggaggtggaggcgggtagatcacaaggtcaggagatcgagaccatcctggctaacatggtgaaaccgtgtctccactaaaaatacaacaaattagcagggcatggtggcacaagcctgtagtcccagctacttgggaggctgaggcaggagaatcacttgaacccgggaggcagagactgtagtgagctgagattgcgccactgcactccagcctgggcgacagagcgagactccgtctcaaaaaaaaaaaaaaaaaaaagagcaagaagtaggcagctcacacctgtaatcccagcactttgggaggctaaggcaggaggatcactagagcccaggagtttgagaccagcctgcgcaaccatagtgagaccccatcgctacaaaaataaaataaattagctgggcatagttgcaagtgtctgtggtcccagctgctcgggaggctgagatgggaggattgcaagcctgggaggtcgaggctgcagtaagctgtgattgcaccgctgcacaccagcctgagtgacagagtgagaccatggttcaaaaaaaaaaaaaaagagagcaggaagtagaattgggaaagaagcttcaggcagggatttgtaaatgaacaaaaccacaggaacatttgcatactgtttaaaaaaaaaaactggttacaatgagtgagtctcatctaccctcaggagaagaaagagggcaaaccagtagtctgaagcccagcccatctggagattttttgggaagatttcctttaaagaggcaggatggctcacgcctgtaatcacagcactttggtaggccaaggcaggcggatcatgaggtcaagggatcgagcccatcctcgccaacttgatgaaatcccctctctactaaaaatacaaaaattagcatgagcccaggaggtcgagactgcagtaagctacgattgtgccactgcactccagcctgggtaacacagtgagaccctgtctcaaaataaaaaaataaaataaaataaagatctgaagttatgcacatactgggggacaggtcattccaggggcagaagagctgagtacagttgacaatgcgtaaagcaccatggtatgcctggaggggagaaaccacaggcagtttggtgttcacagagtatttgttgagcaacttggaatgagtttggatcctggagactgttgaacacccagagctgaggatcttgaacttcacagttaggtaatggcagcaaaggaaaccaaagtgggtggttatcgtgaccaagttcacataagaaataaggaagcatatcaggtgtggtggctcacgcctgtaatcctaacactttgggaggctgaagcaggaggatcccttgaagttaggagttcaagaccagcttgggcaacatagcaagaccctgtctgtatttaaaaaaataaacatggtggctcacgcctgtaatctcaccactttgggaggccaaggcgagcagatcatatgaggtcaggagttcgagaccagcctgaccaacatggtgaaaccctgtctctactaaaaatacaaaaaattagccaggtatggtggtgagtgcctgtaatcccagctactcgggaggctgaggcaggagaatcacttgaacccgggagacggagattgtagtgagctgagattgcaccactgcactccagcctgggtgacagagcaagactccatctcaaaacaaacaaacaaacaaaaaagaaatgaggtgagttcagcttgggaaatgttgaatgtcagatgcctttggcctattcagagggagattgccgaagcacagaggagagttcatggcagggtttaattatttttagcgctcacatgtcccagattcggccagtgggagttcccccaagctggttcctgtgtcctgtgcatcacccatcttctttctcctttacttctttcttaagccacttcctttctggcatgacagcgtgttccaggatcatcttgtacttgcacctgccctgccctggccctagaatcagccaattctttgaggcatcctgcttccttttagtgggggaatgatttgagaacaaaatatactactacatgatactacattctgacaagaaaaaaaacacagccataagaaataaagccatggccaggcacagtggctcctgtaatcctaaccctttgggtggcggaggttggaggattgtttggggtcaggaattcaagaccaacctggcccgcatagtgaggcctcgtctgtattaagaaaaaaaaaaaaaagaaagaaggaaagccatgtttggataagtttagtcttctgattatttttgctaaagttttaattttttttttttttttgagacagagtctcgttctgttgcccaggctggagtgcaatggtgcagtctcagctcactgcaacctctgcctcccgaattcaagcgactctcctgcctcagcctcttgagtagctgagattacaggttcctgcaatcacgtcctgctaatttttatttttagtagacacagggtttctacatgttggtcaggctggtctcaaactcacgacttcaggtgatctgcctgccttggcctcccaaagtgcagggattacaggggtatattttatatttaaagcatatttaacaattaagggccaggctcggtgtctcacgcctgtaatcccagcactttgggaggctgaggtgggcagatcacctgagctcgggaatttgagatgcacaacaagagcgaaactccgtctcaaaaaaaataaataaatataaaatatacattatggccgggcatggtggctcacgcctgtaatcccagcacgttgggaggccaaggcgggcagatcacctgaggtcaggagttcgagaccagcctggccaatatcatgaaaccttgtctctactaaaaatacaaaatttagccaggcatggtcgtgtgcacctgtaatcccagctactcggaggctgaggcaggagaatcacttgaacccaggaggtggaggttgcagtgagccaagatcgcaccattgcactccagcctgggcaacaagagcaaaactccatctcaaaaaatatatatatatacatacacatatacgtatatatgtgtatatatacgtatatatgtatatgtatacacacattatatgtaatatctacttttaaatataaacataaatattataaagcttttattgcaattgttcattttagaaacttcagaaaatacaaattagtaaaaagaagaaaataagtctgtaataccacttttaaggactattttgaaaacctctagctgttttttgagataaatttacataccaagacttttttttaaaaaatcataatgatgactttttcataggactgtgtaggataaagcttgtgaaatgtctatctaacatattttgtaatatatgaaaatttcagctaaacttgttctatagcatcacatggtttcaatatattattagaaaatcattccataaacaatggtttggtatatagtttcaacaattcaaggctgggcacagtggctcatgcctgtaatcctaccactttgggaggccgaggcaggcaaatcacctgaggtcaggagttcaagaccagcctggccaacatggtaaaaccctgtctctactaaaaatacaaaaattagccgagcatggtgtcaggcacctgtgatcccagctactcaggaagctgaggcaggagaactgcttgaacctaggaggcagatgttgcagtgagccaagatcttgccactgcactccagactaagcgacagaatgagattccatctcaaacaaaataaataaataaaataattcagcaggatgaggtggctcatgcctataaccccagcactttgggaggctgcagtgggactactgcttttgcctgggagttcaagaccagcctgggcaacatagagataccatgtctcagaaaaaaaaaaattaatttaaaaaaaaagaattcattgatgattctgtatttacaaatatattcctgcatcatttgttcatggtaaccaggaaattgcaatgcatatatacatgctgtcatttccaaagccgctgtcttccagaattggtactgattctagtagacttttcattctggtgttaaaaatataattaatataggaatgtcttctacctaatagcttttttccccacaactccccaaccccctcactctagaggccttaagtagtctaagttaatcagcttagtctgaaatataatactacctaggcatcttgttggcctagtatttcttactcttttatggaatgaactgtgcaattgttttgtgtggttaaaaggtattctaggtcaggtatagtggctcacacctgtaatcccagcactttgggatgccgaggtggtggatcacctgaggtcgggagttcgagaccagcctggccaacatggtgaaaacccgtctctactaaaaatacaaaaattagccaggtgaggtggtgtgtgcctgtaatcgcagatactcaggaggcagagacacgacaattgcttgaacccaggaggcagaggttgcggtgagctaagattgcaccactgcactccagtctgggcaacagagtgagaccctgtctcaaaaaataaaaaacaaaataaataaataaaaaataaaaggcaatctaataaagttgttgctttttttttttcccaattccagagtggactgatgtactggccctttgtacaggtaagttccacctactcagtaatatgaactcagggctttggtttccatgtggccctaacggactctctctctgttccagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcctgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggagcttgcagtgagcagagatcaggccactgcactccagcctaggcgacagagcgagaatctgtctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttatgtctataatccaagtgctttgggaggcgaaggcaggtggatcatctgagcccaggagtttgagaccagcctaggcaacatggcaagagcctgtctctccaaaacctacaaaaattagccaagcatggtggtgtgagcctgtagtcccagctacttggaagactcatgcaggaggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatcccagcactttgggaggccaaggcaggtggatcggttgaggtcaggagttcaagaccagcatggccaacacagtgaaaccccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattcacaatttatcagtcttttttgtttgtacaaaaactaatataagttattctcttttatttgtattgtgattggtttgatgagagggaattaggccacttgagagtttgtgcgtgtttataattttctggctgggcccggtggctcatgcctgtaatcccagcactttgggaggccaaggcgggcggatcacttgagctcaggagtttgagaccaacttgggcaatgtggtgaaaccctatccctaccaaaaatacaaaaattagccgggtgtggtggcttgcacctgtcctcccagctacttgggggtgctgaggcaggaggatcactcaagcccaggaggtggaggttgcagtgagccgagatcacgccactgcactccaggaagggcaacagagcaagactgtgtctataaaaaaaaaaaaaaagaaagaaaagtaaattaactttggtatttcaggttgtatttatatggggacttcacatcaactatgttcactacaattgaccaagttaagtgtagacagtctctttaatagagagattatctggaactgcaattttttttttttttttgagacagagtttcgctttgtagcccaggttggagtgcagtgtcgcgatctcgcctcactgcaacctctgtctcccgggttcacgccattctcctgcctcagcccaagtagcagggactaaaggcgcccgccaccatgacccactaattttttttttttttggatttttagtagagtcggggtttcactgtgttagccaggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggaaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaatgactgaaaaagtttcttttaatactttcaacagctgatacataaaaagggaaatctggaatttgaagataaagtatgtgctggagttgaaaggttaggaacacatgaagatctgtgaactgtagctaaccttgtgaatagaaggcagtaattactgagtaacatttttggtatatatcaagtaaaagcttgtcttttcctagttctcttctcctttgttaagtgtatccttctctaactacatctttattcatccttttcttccttcctctttctttgtccacaacccaaccaaacccactgctctctcctctcaccccctgcccgtgccatgaccacttgaacattccaggagggcagaataattgtaataaggctaagggcttattacacttcttacacttaaggactcaacagccttgctttagagaggatggtagcggaggatcctctctggtctctgtgagaagaaaagagaaaggaccatcctacggagaatttatttttatttttatcttttttgagatggagtctcactctgttgctcaagctgcagtgcaatggcatgatcttggctcactgcaacctccgcctcccaggttcaagcgattctcctgcctcagcctcccgagtagctgggactacaggcatgtgccagcatacccagcgaatttttgtatttttagtagagatgggatttcaccatgttgcccagactggtcttgaactcctgacctcaagtgatctgcctatctgtctatgatattttaggttggcagttgcaaactaatggtccacagcgtgctttttatgacacctagaaggtttgaagactttgatttcatagtaaaaatctgggtttcaggctgggtgcggtggtgcatgcctgtaatcctagcactttgggaggctgaggcaggtggatcacctgaggtcaggagttcgagaccagcctggccaacatggtgaaactgtctctactaaaaatacaaaaattagccaggcgtggtggcatgtgcctgtaatcccagctactcgggaggctgaggtgggagaattgcttgaaccagggaggtggaggttgcagtgagccaagattgcgccactgcactcaagccttggcaacagagcgagactccatctcaaaaataaataaataaacaaataaataaatatataaaatctgggtttcaggccaggtgtggtggtgcactcctgcaatcccagcactttgggaggcggagatgggcagacagcttgagcttaggaattccagaccagcctgggcaacatggcaaaacgccatctctacaaataacacaaaaacattagctgggtgtggtagagtgcgcctgtaatcccagctacttgggaggctgaggcgagaggattgcttgaggctgggaggttgagccacgatcacactcacacacttcaacctgggcaacagagccagactgtctcaaaaaagaaaaagaaaagaaaaaagaaaagaaaaaaggaaacgtctgggcacatgcctgctacagtcctctatgaagcaatgtgccgcagcaggggtccctaatccctgggccatggacctgtactggtctgtggcctgttaggaactgggccacagagcaggaggtgaatagtgggtggacaattgaagcttcatctgtatttctggccgctccccattgcttgcattgctgcctgagttctgcctcctcttagatcagcagcatcattagattctcataggagcataaaccctgttgtgaattgcacacacaagggatccaggttgcatattccttatgagaatctaattcctgatgatttgtggtggaacagtttcatcccaagaccattaccatcctgcgctccatcccttgctgcctgtggaaaaattgtcttccacaaagccagtccctggtgccaaaaatgttggggactgctgtgctttagaatgtgccttgaatctgcagcctctattgtatagttccctatagactttgcttcctaccatcttacattctgccttataggcatttgtgtttgcaactcttgtttttgttagtatgctacgctggtgacattgaccaaattgaccacacattaattataagcttagttggtgatgacctcaatggaataacgtgacataagtactgtgacaatacttcttgcatgtatctgctggtagaattgtaaacctggtggtccgagatggtctaattcgatcttcctatgtatctacttatattaatagtggtagcatttgaggtggtgattcagagtttcaatgcctcttctcatggcaacaacaaatgttttccttctgaatcagcattaacctagatgttactgcagatcaaaattagactgtacattttcaaccacagaaatattgggcagtaaacatttttcttaatattgattgcctacataggttatgtaattagcatatgtttatagttttgtgatttatgtgtggctgctactgagccagagggggtaaagcaacagcgttttctcagttgtgtgagcagcattacgttataatgaataggtaatattaaattgggctgatgaatcatattacagtaatccaatatttcacttgtaaagtccctgaggtttacagaaggaaattttttctaataacaagaagagtgaggcatgtgctttggtctttatttcctagttatacgatcctgggtaaggagctcaacctttctctgccaaaattaaatgaggattaaatgagatcatatatgtgaaggtgtgaaggacagtgcctggcacatagtgggatcaatcaatgttagtatctctaaaatagagattgagtctgaaggttcataaagtggtagaacagatcttaagattcccaaatgatagaattgttatttatttgcctaagtagtagtagattacttattgtatgtccaggggatccttttttttttttttaataatttttatttctttaagacagagtctcactctgtcccccaagctgaatgcagtggcaccattttggctcactgcaacctctatctccctggttcaagcaattctcctgcctcagcctcctgagtagctgggattacaggtgtgcaccaccatgcccggataatttttgtagttttagtagaggcaggattttgccacgctggccaggctggtcttaaactcctgacctcaggtgatccagctgcctcagcctcccaaagttctgggattgcaggcatgagccactgggcctggcctttttttttttttttgtgaggcaggatctcactctgttgcccaagctggagtgcagtggcactaccatgcctcactgaagctttgaactcactggctaaaaagattctcccacctcagcctcctgagtagctccatgggtatgcaccaccacaccccattattttattttttgagaaggagtctcactctgtcacccaggctggagtgcagtggcatgttcttgactcactgcaacctccacctcccaggttcaagcaattctcctgcctcagcctcctgagtagctgggattataggcgcatgctatcttgcctggctaatttttttgtatttttgtattttttaactagagacagggcttcaccatgttagccaggatggtctcgatctcctgaccttgtgatctgcccacctcggcctccaaaagtgctgggattacaggtgtgagccaccgtgcccagccctggtattttttttttttttttttgtagagatgaggtcttactatgtggcccaggctggtcttacattcctggactccgaccttgacctcccgaagcgttgggattacaagcatgagccacctcgcccagttcccttcttaaatagttttaagggggagaagaaagaaaaagactgattttcttcccttccactaccaagacaggcaaaacacaccagaacactttgcttagcatttcttttctaaagtgaccaaaatttataatagacacttaaaatgtgtactggaatatatcccaattatatccccagtctataactcagctatatgcagctcctttgtcttattaatgctatgaatcagcaatagtttatgttttcatatcacctgaggccatgcaatcctcttttttggttgttgaaataatttctataactatttcacaatttcaattgccaacattaattcaacagtatttaagctgtctgtcccagacactatgctagcctttggagatttccaaggtgaataaggtgaggacccggctatttgcctacggtctagcagacagacctttttttttaattttttgagactgagtctcgctctgtcacccaggctggagtgcagtggtgcgatctcagcttactgcgagctccgcctccccagttcacgccattctcctgcctcagcctaccgagtagctgggactacaggcgcccaccaccacacctggctaattttttgtatttttagtagagacacggtttcactgtgttggccaggatggtctagatctcctgacctcgtgatccgcccgccttggcctctcaaagtgctgggattacaggcatgagccactgcgcttggccaccttttttattttttatttttatttttttgataggagtctccctctgtctcccagcctagagtgcagtggcacgatcgtggctcactgcaacctctgcctccagggttcaagtgattctcctgcttcagcctcctgagtagctgcaacttacaggtgtgtgtcaccacacccagataatttttgtatttttagtagagacagggtttcgccacgttgtcaggctggtctcgaaatcctgacctcaggtgatctacccgcctcagcctcccaaagtgctgggattacaggcatgagccaccgcacctggccagcagacagacttctaagcaaattacagctaccactttttgtatgctcactaactgtagataagggtctatgccaagccctttacatcatgtggtaattgatatggtgtagttgagtggtttctaccatcgatttccttacctcccccacttcccaacagctcccagttcctttttggggatcttcccagaagatgactttacttggctcaagaggtggagcacatgacagattaagccaatcagggcgtttcatgccccttgctacagggttcagagacaatcatgttatctgcagctgcccaattagagtgaatctcataacctttgatggaaaaccaggacaaaggcatattctctcattgtgtcatagagatgttaatatagatgtaaggcctaggactaccatagccattttttgttaccgtgaaagacatggaggcaagagggtatcactgaaagaatctcagagaaaccctgatgatttcataacctctgatatagcctatgcccaaagcctgctctgggcttttctgttataggagctaggagattccctttatttttcaaaccactgggaattaggttttctgttacttgaaggaaagcatcataaaggatacacaggaccttttttataacacagtagatattattctcattttatttttgtgtgttttgttttgttttgttttttaagacagagtctcgccatctcagctcactgcaacctccacctcctgggttcaagcgattctcgtgcctcagcctcttgagtagctgggactataggagcgcaccgccatgctgagctaatttttgtatttttagtagagacagggttttgtcacgttggccaggctggtctcgaacccctggcctcaatggatccacccaccttggcctcccaaagtgctgggattataagtgtaagccaccacactcagctgattcatttattttcatttttttttgccatacaaaccaacaacttgcaaactcccattataaacatttccagaaatttatggggtacaggtgcaattttgttgcatgcatagatttcatactggagaagtcagagcttttaggctgtccatcacctaaatgacgtgtattgtactgaataagtaacttctcatcatccacccacctcccacaccctaacccttctcaatctccatcatctatcattccacactctacatttctgtgtacacattctttagcttccacttatgagtgagaacatgcaatatttgtctttctgtgtctggctggtttaagataatggcttccagttctgtccatattgctgcaaaggacatggtttcattcttttaatggttgaatagtattctattgcgtatatgtatcacattttctttttttttttttttttttgagacggagtctcgctctgtcgcccaggcggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcccacattttctttatccactcatctgaagatggacacttagattgagtccacatctttgctatagtgcattcactctcattgttatagttgagaaaacaaaggtccttgccctttgccactaagccaatacatggcagagtcaggttgatttccaaacccacactcttatgatcatgcttctagtaactccagtgcagtttaagaggtatatcaaagatacagtagtgacagccaggcatagtggcaggcacctgtaatcccagctacttgggagacaggagaatcacttgcaccggggaggtggaggttgcagtgaaccaagatggtgccactgcactccagcctggtcaacgtagcgagactccatctcaaaataaataaacaactaaataaataaaagggatacaatagtgacataaaggaatgatcagctcattgtgtgtgtgtgtgtgtgtctggtggccatggagatattccagggcaccagacatggacaaaagtatgaagtgaagggctcatggtatatgctaaataaatgtttctattttattttcctttgcgcttctgagaaatttgctgtgctagggaatcttagtgggaggttccaaatgtctctaatgggtccttaaaagtaacacaggggactgagagttactttcaaaaagctagtattttaaaacaggttgtgcagatgaattcagacttttgtttgtttgtttgagacagtgtctcattctgttgctcaggctggagtgaggcagtacaattatagttcactgtagtcttgacctgctaggctcaagcaatcctcctacctcagtctctggagtagctgggactacaggcctccacacctgcataatttttttttttttttttttttttttttgtagagacagagtttcaccatatagcccaggctggtcttgaactcctggcctcaggcagtcctcctgcctcggcctctgaaagcattgggattacaggcatgagccactgtgcctggcccagacaggcccagacttctttaccatggatgagatctttgtcaactcagtgtggccatctcacgctgctttgtcaacaagttctttttttttttttttttttttttttttttaatgagacagggtcttactctgttaccaaggctgcagtgcagtggttcaatctcggctcactgcaacccctgcctcctgggttcaggcaattctcctgcctccgcctcctgagtagctgggattatgggtgcccactaccacacccggtggtacataataataatttttctatttttagtagagacagggttttgccatgttggccaggatggtctcgaactcctggcctcaagtgatccgccctacgtggccatccaaagtgctggaattacaagtgtgagccaccgcgcctggccacattctatcatttttatattggtttagtccatcctgtctttgattccactgccattgcttatttcagatcattgctgtttctcatggagacccttgatactcagagtgtggtccatggatcagagtctcaacatcacctgggaacatctaggaatcttagatacccacctcagactctctggattagaatgtgcattttaacacactgaaatttgacaagcactaataaattttttcactagagtcttccaatgatctcccgactctagtttggttttgttttttcagagatagggtctctctctctctctctctctctctctctctcacccagttgagagtgcagtggtgcactccatagctcactacagccttcagctcctgagctcaagtgatcctcttgcctcagccttctgaatagctaggattacacatgcatgccattacatgcagctacgtttctactttttgtagagacagggtctcactatgttttccaggctggtctcgaactcctggcctcaagagatcattccaccttggcctcccaaagtgctgagattagaggcatgaaccactgcgctgggcccctgcctctagtttttttgtttgtttgtttgttttgagacagagtctcactctatcacaaagtctagagtgcagtggcgcaatcttggctcactgcaaactctgcctccagggttcaagcaattctcctgcctcagcctcctaagtagctgttccaagcattttgagaggtggaggtgggcagatcgcttcagcccaggagttcaagaccagcctggacaacgtggcgaaacccatctccaccaaaaatacaaaaaattagctgggtgtggtggtgcacctcagtggtcccagctagacaagaggctgaggtagaaggatcacttgagcccaggggcggaggttgcagtgagccgagatcctgcaactgtgctccagcctgggtaacagagcgagaccgtgaacattaaataaaaatggattgtctaggggagagagaagttgagaccaaaatagttcaatgctagtagagagtaagggacagagtataggttaataaatttagatttacctaggtagtatcagccagatttgtaggtcaaagtacaaatttacggccgggcaccgtcccagcactttgggaaggtgaggcaggtggatcacttgaggtcaggacttcaagaccagcctggccaacatggtgaaaccctgtctctagtaaaaatacaaaacgaaattagccaggtgtggtggcgctgcctgtagtcccagctactagggattctgaggaaagagaattgcttgaacccaggaggtggaggttgcagtgagctgagatcatgccactgcactccagcctgggccacagagtgagactgtctcaaaaacaacaacaacaaaaacaaagtacaaatttactggtttcaatgactagctcaaacaaaggtgtcatcagctgtcataggaaatacacaagataggatctggaggaagatattaaatttgaagtgcttctgggatatctagtctagtggtgctgcccaacaaagagttgtatagacacatctggaaatataagttcgtaaacttttagcatgtctttactcactttactgtttagtttaggtgaacctttttccagagggtaactcccctgcatagatgatggtaaaaaactgtagagactaaggttggggttataaatacacagtaaatataggtagaatgcaaggaattttttttttttttttttttttttttttggagagacacgatctcaccaagttgcccagcctggccttgaactcctgggctcaagcaatcttcgtgccttgaccttccacagtgctgggattacaggtatggggtaccacctccggccagatgcaaggattttatttcctggatggagcagcattttggagcatccagaaatatcagccctgtatgcaaggggatgctgttgaatcaattccacatgaaatagacaaggcatactagcagttatgttaggatgttattatttgagccatacacagatcagggggcactttagaatttttcttctgcttactcagttcattcatacgttcaacaagcattggctgggtatctaccacgtgcctttcaatatttcagctctgatgatttgaaagtaaatagaacacatttctacttcatgggtatcctcatgtaaatatgtgatttataaatgagttgtattactcacgcacatttcttttcttttcttttctttctttttttttttttttttttttttgagacagagtctcactctgttgcccaggctgcagtggtgtgatctcggctcactgcaacctctgcctcccaggctcaagcgattctcaagcctcagcctcccaagtagctgagtagctgggattacaggcacacgccactacgccttgctaatttttgtatttttagtagagatgggatttcaccatgttggccaggctgatctcaaactcctggcctcaagtgatttacctgcctcggcctctcaaagtgctaggattacaggcataagccaccatacccagccctcacacacacttctggtgagtataacttggcatgacacttttgaaggatggcttgataatataaaatgcctttaaaaatgtgcatatcctttgattcagcaatttcacatcaaggaatttttcccaaaagaataagatatctacaaagctttaactgcaagactgctcctcatattttgctgataatctcgagaatttaggaataacctgtttgtccccagaaccaaggagattggttatataaattattctatagctagcaggaaaccagtggatgattttctttttaatttttttttttttttcagagacaggttcttgttctgtagcccaggctggagtgcagtggtgtggtgatcacagctcattgtaacctcgaactcctaagctcaagcgatcctcccacctcagcctcccaatggaggtttttaagcaggagagtggcattggatgtgtgtgtgtgtgtatctaattttagaagtcgtgtggagaatggttttcagtagggagaaaaaaaacccagaaaagatgttttttgccacagtgtaggtcagagatgatgcaaaattgagctaacttaggcagtaggaaggaggaggagaatcagatttgggagctatttccaaaatagagtcaataggatttgttgactgactgtggcagagagtgttgggatgttgcagaataaggtaccaaggatatactgagatttccaactcggatggagcaggtatgggggctgatatagtgaatctgactttgaatatgatcaggttgaggttataaatccctcttcatgggcactgccatggtggtttcttgaaacacctttgagaggtgatgtgggatgtggcgaagtgtttaggctttgagactggctggctgagtttgaatgctggttctgccatgtgttagcaagtaatttacttacccaaactctctgagctacagcccctgtctcacaggatactacagcatagaatgaagaaggataaatctggtacagtgcccagcacatagtaaccacgcaataaacatcagctttaaaaaaacagacaatgcgggctgggcgcagtggctcacgcctgttatcccagcactttgggaggccgaggcaggcggatcacaaagtcaagagatcgagactatcctggctaacttagtgaaaccccgtctctactaaaaatacaaaaattagctgggcatggtggtgcatgcctgtaatcccaactactggggaggctgaggcagaacaatcgcttgaatctgggaggcggagattccagtgagccgagataacgccactacactctgacctggcgacaaagcgagaaagcgagactccctctcaaacaaaaaacagtcaatgctgcctgtaatcccagtattttaggaggctgaggtgagcagattgggctgaggttgggaattcaagaccagcctggccaaaaggtgaaaccctatctctaccaataatacgaaaaattagccaggcgtggtggttcatgcctgtaatcccagctacttgggacaggcgtggtggttcatgcctgtaatcccagctacttgggaggctgaggcaggagaatcgtttgaacctgggaggcggaggttgcactgagccgagatcgcgccattgcactccagcctgggggacagattgagactccatcaaaaagagaaaagaaaaccacaaaaaaactcagacaattctataatagagggagaatacgcatgcaacccagggatttttctcagataccctacccattctcaaatagcatgtgctctaagctcctatggtaaaagcttcatgcccctgcaaaactcacacacctgatcccactcctcaagcacttcatggagaagcagcagctcccagctctataacagataggggatttcaggtcctaagtcttgagagcaaatatttcctcaacttcttttctctctctcaagcctcctttaagaggaatacatactatgctttctggaactctgttctaccttccaaacccatttatatcttttacgattttttttccccaagattgcggatattttctattttttttctggagacagtctcgctctgttgcccaggctggagttcagcggtgcgatctcagctcactgcaacctccacctcccgggaggaactgccagaccatcttccaaagaggttgcaacattgtatattcatggtatgagagatctaatttttctactcaatgtcattttaatggtgtggtgttttgttttgttttgttttgttttgttttgttttgtttgagacaggatttcactgccactcaggctggagggcagtgatccagtcatagctcactgcagcctcaacctcctgggttcaagtaagcctcccaccccagccccctgagctgctgggaccacaggcacatgccaccactcccggctaattttttaattatcacttgtatagatgggatctccctatgttgcccaagctggtcttgaactcctgggctcaagcaatccttttgcctcaatctcccaaagtgttagtgagaggtgaagcccgctgcatttcctgtatggagtggggacttggagaacttttctgtctagctaaaggtttgtaaacgcaccaatctgcactctgtaaaaactcaccagtcagcgctctgtgtctagctaaaggtttgtaaacgcaccaatctgcactctgtaaaaacgcaccaatcagcaggacatgggcagggacaaataagggaataaaagctggccacctccaaccagcagtggcaacctgcttgggtccccttcaacgctgcggacgctttgttctttcgctcttcacaataaatcttgctgctgctcagtctttgggtctgcaccacctttgtgagcaataacactcactgcgagggtctgcggcttcactcctgaagtcagcgagaccgtgaacccaccggaaggaaaaaactccagacacatctgaacatctgaagaaacaaagtccggacacaccatctttaagaactgtaacactcactgcgagggtccacagcttcattctttaagtcagagagaccaagaacccaccagaaggaatacattccagacacattaggattacaggtcaatgtcattttaataggtttttggttttgatttggagacttcatttggtaaattctcaaagagtcagcactcaaaatatcagctaacacgttgcttcaacccaagaaggatgatgatcatgatgatgatactaacttgtactgaggacctcctatgggctgccatactttatctcatttaatcataatagtcctctggggctgggtgtggtggttcatgcctataatcccaacactttgggaggcctagtcaggcggatcacctgaggtcaggagttccagaccagcctggccaaaatggtgaaacctcgtctctactaaaaatacaaaaattagccgggcctggtgatgtgcgcctataatcccagctactcaggaggctgagacaggagaatcacttgaacctgggaggtggaggttgcagtgagccaagatcacactactacactccagcctgggcaacagagtgagactccatgtcaaaagaagaagaagaatagtcctcaccactacactccagcctgggcaacagagtgagactccatgtcaaaagaataataataataataataataatagtcctcaccactacactccagcctgggcaacagagtgagactccacatcaaaataataataataataatagtcctcagaatagataataatgtcattagcatttgaaagaaagtgaagattaaagaaattaagggacacaacacacagagtcacacagccagcaggtggcagagtcagggctcaaactcagatcctctggatttcacggcccgcatttttgaaaaccatgcgattctcataagctcagtgtcatggacgtttgaaattctcaacatgctggatgaagtatcaaattaccaggatgagattgcattatttttcctttcaatcaagcaaaatgacagttataaaagtgtcttgcactggcccctgctgccttggctctttataatcacccaggatccctccaagtccttggcattcccagcaaagccgaggcactgagccaggacaagcagccagggctcgggggcggtggcgggggggtgagggggtgaaggggagggtgtgggggggtgttgctgcttaatacttccatgcagatggtgacttcagccagttactgaacttgaagcattatcaccctatgctaatgcaaacagacagggttctggggactgtggtggcagggatagtttgtcctctaggattgtggaattgtattacacacttttagaaatgaaatgtattcgtttttgaattctaaaacaatatgggctcaatatagatggttggaaaattcataaaattaaaaaaaaatctttcccaaatttcaactctagaaacaaccattgttaatattctcttgtatttactgctagtcattttatttttcataccttaaaaccattatttattgctgggcgtggtggctcacgcctgtaatcccagcactttgggaggctgaggtgggcggatcatgaggtcaggagatcaagaccatcctggctaacacggtgaaaccccgtctctactaaaaatgcaaaaaattagccgggcgtggtggcgggtgcccgtagacccagctactcgggaggctgaggcaggagaatggtgtgaacccgagaggcagagcttgcagtgagccaatatagcaccactgcactccagcctaggcgacagagcaagactctgtctcaaaaaaaaaacaaaccaccattatttatttatattttagagacagagactcactctgtagcccaggcaggagtgcagtggcacgatcatagctcactcactgcagtctcaacctcctgggctcaagcaatcctctcacctcaacctcccgagtagctgggactataggtgtatgccacaacagctggctaattttttttttttttttttggtagagacagggtcttgctgtattcctcaggctggtcttgaactcctggcctcaggcaatcctcctgcctcggcctcccaaagtgctgggattacaggtgtgagccactgcacctagcctgatttcttttctgattataaaagtaatacaggccgggcttggtggctcatgcctgtaatcccagcactttgggaggccaaggtgggcagatcacttgaggtcaagagtttgagacgagcctggccaacatggtgaaacctcatctctactaaaaatgcaaacattagctgggtgtggtggtgggcacctacactcccacctacttaggaggctgaagtgggaggattgcttgaacctggcaggtggaggttacaataagccgagatcaagatcgtgccactgtactctagggtgggcaacagagtgagactatctcaaataaataaaagtaatacgtatactttgtagaaacattggagaatacaaacaaaacatttattatcatgacatacataggtagtcactatcaatattttggtgtatgacattttagtgttttttcaccctggatgtgtatacatgtttgtatatacgtaaacaggtaaaattggaatcacagtagccgggtgtggtagcccatgcctgtaatcccagctctttgggaggcagaggcaagagaatcacctgaggccaggaggtcaagacccacctgggcaacatggcaaaaactacatctccgctaaaaatacaaaaattagttgggcaaggtggtgcatacccgtagtcccagctactaaggaggcctgggcgggaggactgcttgagcccgggaggtgagcagtgagccgacatcccaccacagcacgctagcctgggtgacagagcgagactctgtctcaaaaaaaaaaaaaaaaaggaatcacagtatttttaaatttctaccattatcattctataaaatatgattgagattacagtgtgcacttgatcttagccaaaagatccagaatgacagctcacactttatattacaatttgtattctacttttcctgatattttgattaaattgtgctatgttttccctatgacatttccctattacatttctttgtaaacatcattttaaataagtgtacagtgttacattgcaggcataccataagtttagccatttcccttttgtaagatactgacccttttctaattttttctacagtttacataaattgtaaaaaaaatatattgtgtgaatgtatttttagtaattcagatattccttcgggtagatttccatgagttgaatttttagatccaatagatgtattttttcttttttaaattataaaatattttaatgtagagataattacatgacaaagatccctaaatgcaccaaccgtcttttaagggatacacacccttttatttatatattatgtctgtaagattcatccattttgttggtagtaatttgtttgtttttttttttttttttttgtgagacagggtttcactctgtggcccaggctggagtgcagtggcatgatcacggctcactgcagcctgaacctcccacgctcaagtgatcctcctgcctcagcctcctgagtagctaagactacaggcacacaccacccatgcctggctaatttttgtattttttgtagagaagggattttgccatgttgcccaggctggtctcgaactcctgggctcaagcgatttgcccacctcagcctcctcaagtgctaggattacaggtgtgagccattgtgcctggccagtagtttggtctttttcgttgctgtgcagattcagttgtatgaatatagcataatttttgtccattctattgttgatagacatttgagttgttttcatttcttgtcattatgagtaaagctcttaacattggtggacacaagtatgtatttctcttagggatatatccaggaatagaattgctgccagacagaaaaatatatatgtatttgtagctttagagggtattgccagtctttttttatttctttcttttttattttgagacagtctcactctgtcgcccacgctggaatgcagtggcgcaatctcagttcactgcaatctctgcctcccgggttcaagcgattctcctgcctcagtctcctgagtagctgggattacgggcatgtgccatcacgcctggctaatttttgaatttttttagcacagacgaggttttgccatgttgggctggtcttgaacccctgacctcaggtgatccgcccacctcagcctcctaaagtgctaggattacaggcgtgagtcaccacgcccagccattatctctcattttctaaagtggtagtaccattttatactccgaacagcaataaattgtagttacattcttactaactgctaactcatttatttactagcatctggactaacatttggtattgtcagtctttttaattttagtcattctggtaagggtgtagtgcccaccagccatctccaacagattttaacatatatgcttcagatctcttttaagaaatataaatttaaatattcattagtgaatctagtaagggatgtgtgtgcgtgtgtatatatatatatattgtatatatacacacacatatacaagaaaataacatacatattatataaaataacgtatatatacacatactgtatatatacacacacaaactatatatatatatgtgtgtgtgtgtgtattttggagacagggtctcactctgtcatctaggttggagtagagtggtgtggtcttgcctcactgtagcctcgacctcccaggcccaagcagtcctcctacctcagcctcctgagtatctggaattataggtgtgtgccaccacacctggttaatgttttaatttttgtagagatggaaaactgctttgctgcccaggctggtctcgaactcctgagctcaaggattcctcccaccttagcctcccaaagtgctgggattataggcatgagccaccgcacctggccaaggtctgtatttttcttattgtactaaacttgcaacttttctgtagatttaaaaattttcaaaatactgtaaatagtttaaaaatatataaattttagatatagctgaaactaactacttaccctttcccagcctcctaaagtaattactatcctgaatgtaatgtttattgttttttttttttttttttgagacagcgtctcactgtcactgaggctggagtgcagtgtcatgatctcagttcactgcaacctccgtcccacgggttcaagtgattctcctgcctcaacctcctgagtagctggaattacaggtgtgcgccaccaggcccggctaatttttttttttttttttttttttgtatttttagtagagacggggtttcagcatgttggccaggctggtctcgaactcctgacctcagactaaccgcccgcctcagcctcccaaagtgctgggattacaggcgtgagccactgtgcctggcctggtacaactaattttaaaagcaggttgacactctagtccaactggcagatgtgcataccccatgccattgtaatttttccccctagaaaaactcctattcagtcgtacagggaaatgagtataaaaacatttgctgctgccatgtttgtaattgtggacaattgggaataatctttatacctcatcaatgaaaaaatagaccaattatggttcattcatgtagaatactatacagtagactatgaaccagagttacatgaatcagaattcgtatttctcaaaagcataatgtgggccgggcacggtggctcacgcctgtaatcctagcactttggcaggctgaggcaggtggatcacttgagcccaggaattcaagaccagcctgagcaacacagtgaaaacctgtctctatctttttaaaaggaagaaaagcatattgtggaacaacaacagaaaaaagcaacttgcagaattataaagtatgatatcatttgtataaattataagaaaatgttaaatagcgctattatatataatttgtagagttatacatatatacctgagaacaataaacattacattcatgcagccaggcacagtggctcattcctgtagtctcagcactttgggagaccaaggcgggcagatcacttgagctcaggagttcgagaccagcctggccaacatggtgaaaccacatctccattaaaaatacaaaaaattagctgggcatggtggcacgcctgtagtcgcagctactcaggagcttgaacccaggaggtggaggtttcagtgagccgagactatgccactgcactccagcctgggtgacagagagaaaaaaacagttgtaccaatttatactcccactagcattagataaaagttcaaattatgccaggcatggtgtctcacatctgtaaccccagcatttttggactctgtctcaaaaaaaaaatccacatcttttacaacacatgattgttagattttttagtttttgcctatcggatgatatattcttatttacattttcattttccttattactaagggggttgagcagcttctcacattaggccttcctcctctgcccacatgacatgactattcatattctttccctgtttcctactgggatatcattttctttttttcgtttcttttctttttttgagacggagttttcctcttgttgcccaggctggagtgcaatggcatgatctcggatgactgaaacctctgcctcccaggttcaagcgattctcctgcctcagcctcccgagtagctggaattacaggcctgcgccatcacagctggctaatttttgtattttcagtaaagatggggtttcaccatgttggccaggctagtctcaaactcctggcctcaagtgatccacccacctcggcctcccaaagtgctgggattacaggcatgagccatcgtgcccaggcactgccatggtgttttttgtttgtttgtttgtttgtttttaaagataaacctctggggtttctggaaagtaaagccccatgctccaaacagctctgctatacctgtgtgcaaaatattttcatctctctctctctctccccaaagtgcatgcaaacacatatggaactgacataggcatccactgtcgcacttcaaattaaacagacgcacacgacagatattctcacagaaaagcagtcagccaagcccagaacccatagatctaggtccacactcacgcctctgcatgctccccagaaagacggatgcatcgcccgcaggtagagacgggctcaccaatcccactcaaaacccgctgccggcttacagctcgcaagccgcccacagtgccagccccatgccaagcatcactaggggctctagaataggcaggggccttgttctcacttcctttgtgttgcttttattttagttgttttgtttgttgtttttcttagagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggcttggggcggcaaaagggtcaaaaggcacacaccgttctcttttctctcttgactcagttaaagtctgcttgggcacaactctagaaggcagtttcgaaatagaccggctgtatttatttactggttctctctgcggtgtttggatgtcaacatttctaagtaaacgaaggattttgtttttcattaataggatacaatagttgaaactcctgccctcaaagtgtagaggcagcgtcaggggctccagggtcactggaggtccctgcaaacccgggggctccccaaagccgctgctctcacatggcttgcccaccaggctgggaaggagaggtccttctcagggacccggcagcttcctgcctcggctctgggtcactgctccgcgctctgccccagcacggatctctgagcgatgtagggctaaagtattgtgaatgtgatcttattctgtcctcacctggtggaaaattgtgtgtgcgcgctttctttctctatacctgtaattatggatttagaaaatcttcctagaagggctcaactgtgttctgattctgacgggttgaagttgaaatcacaatccaatgtcttagtggttcatgggctaggatggatgtcatagcactgccaacctctttccttttctttttttttctccctttttaaccttggtctttctttctagttcatcctttcaagacccaatgacttggtgctttggcataatatcagggcgtcagggctgagggtctctgtttctttctttaatttttaagtgcacatagtgggtgtccatatttatggaatacatgagatattttgatacaggcatacaatgtgtaataatcacatcagggtaaacggggtatccaaaacctcaagcatttatccttttttttgtgttacaaacaatccaattacactccttttttaaaaaagcccagctgtgtgactaattatactcttttagtttagcttttttttttttttttttgagacggagtttcgctcttgttgcccagactggagtgcaatgacacaatctcggctcactgcgacctccacttcctgggttcaagcgattctcctgcctcagcctccagagtagctgagattacaggtgctcgccaccatgcctggctaacttttgtatttttagtagagatggggtttcaccatgttgggcaggctggtcccgaactcctgacctcaggtgatcggcctgccctggcctcccaaagtgccgggattacaggtgtgaggcaccccacctgccctcttttagttatttttaaatgtacaataaattgttgactgtagtcatcgtgttgtgctatcagatactagatcttattcattctatctacctatatttttgtacccattaaccatctctgtgtccccccatcccaataccctccccagcctctggtaaccatcattctactctgtatctccatgagggtctcttgtttcttacaagctcaaaataatctcaacaatggctgccttttattgctagatgaccatgtgctgagaactctaaatgcatcatttcatttagtcccctcaacaacctcctgcagtactaagatttataaatttaaatcttgcctagatttaaaaaaacattttaaaataaaaattttaaaacaaaacattttaaaataaaaaatttaaatataaatttaaaatcttgcatagatttaaaaaaacaaaacaaaactgggacttgttaggtgatctgacagttaagtggcagaaccaggatttgaaccccggtctgttggaccccagagcctgcttttaacatgaaggtttattgctttcatggtttcagaaaacttcctaagtctattgagatagtcacagaacatgctcagtgattttataattatgtggcagccctgttgctctctgaagctcacagaggccttaaaaaaatgctgggtccacgcagaatggaagctgttcacaagagtgctgctttgaatcctcactctgtgccttgctggctatgtgactttaggagtattgctaagcctcactctgccttcattttctgaaaatagagattatgtctttattgtgtatactaaataagatgatacatatagtactcaaggttaagtgctcaatacgtattgttcacttccattcggttactgcacaacatttatagacagaacctgcttttactctttgcaaggaattatgtaaatattggtcaattcttcaataatgcccttgtagctttttatatcttaacattttatgagaaaaaatttgaaacatgcaggaaaattgcagcaagcacccaatttacagcagtttcaatcctgaaatttttgtacttctgggtcctatgctgcacactgttaaaagtcaggtataaggccaggcgcattggctcacgcctgcaatcccagcactttgggaggccgaggcgggcggatcacaaggtcaggagatcaagaccatcctggctaacacggtgaaaccccatctatactagaaatacaaaaaattagctgggtgtggcagtgggcgcctattgtcccagctgccggggaggctgacacaggagaatggcgtgaacctgggaggcggagcttgcagtgagccgagattgcaccactgcactccagcctgggtgacagagtgagactccctctcaaaaaaaaagagtctggtataaagtccttcttaccctctgtttcaaaccatcaaagactcagtcttgcttcctagtcaaaggcaagaggaacagctcctgatctgtacttgcgtggatcctcaaatctggtttttcttttcttttttgagatggagtctcactctgtcccccaggctggagtgcagtggcatgatctcagctcactgcaacctccgcctcccaggttcaagccattctcctgcctcagcctcccaagtagctgggactacaggcgcctgccaccacgctcaactaatttttgtagttttagtagagaggggttttcactatgttggccaggctggtcttgaactcctgaccttaggtgatccacccacctcagccttccaaagtgctgggattacaggcatgagccaccacacctggcgaaagctgaaattcttaaaacgtggatccagagtctaacttttgaaacttgaatctggcaagttttattttctagactatttttttttttttttgagacagggtcttgctctgtcgcccaggctggagtgcagtggcacaatcagctcactgcaacatctgcctcccaggttcaagcaattctcccgcctcagcctcccgagtagctgggattacaggcatgcaccaccacgtccggctaatttttgtatttttactagagatggggtttcaccatgttggccaggctggtctcgaactcctggcctcaagtgatctgccctccttggcctcccaaagggccgtgattacagatgtgagctaccatgcctgggcctgttttctagatgcgtgtttgcacgcagggggtgtttgattaaaccttttttggaacactctttcaactctcagggtatctatggatccattccataaagcctgggccctccatttatttattaagtgtgaaaattagtacttttgtttctatggcatgacaattgccaagccaatgttgtaacacatgaaatgctggagaaaagaagagtccccttaaaaagaagacatgctctgtttaacttccacacattttaaaatattttatgttaaacactgagtaggtgtaaattaaacagaattgaagaggggagggagactgcagaactggtcttttttagttaagattgtgttgactgctattttaaatttcaactatagtttttagataaaagatatgtaatgtgctatatcagagtagcaaagaaggaacgttttgaagttaggctgaatgagttcaaaccagcctcattcagctgtcacttggtagatttgtgaccctgggaaaattgctcaaggtctctgtgtgtcagttgcctcatctgtgaaatggggataattgtagtaatgcgcacttcggactcttggaagattagatgagataatgtatataatgcatttagcacagggcctcacatgctgaaagcgctcaatcaaggttgaatggttgtcataggaggacagaaggggattgccccagcaatatttgcagaggttatcccaaactcaccagttacagcttttcattgcttccatttcttagtaaattctggttaatgattctgtacatactgccttcctcatgggaacatgtggagaaaggcttctgcacccttacaaaccatctagtattttctcctttgagaaaggttcaaagtaattgctcccagccaccttcaacagcgtttttccactagcagggaggttttttccccgctcagctggaaaatgtatagtgacatttcagcgtggttagatatataaaaatactgctttcaaccaagtgtaattaattgagggagacatgcagacaaggtgccttttgaaaaagcgcagagcttttcagaaacacagttgtctctgttgtggccatttcttgatagatttgtatgtgtcttaaaggatgatcaagattttggacaggggaaatggaggagttggaggcgggagaggggaatgccaggagaggtaatagcatcaactggctgggtgtggtggctcatgcctgtaatcccagcactttgggaggctgaggtgggcggatcgcttgaggtcagcagttcgaggccagctgtcccaacatggtgaaaccctgtctgtactaaaaatacaaaaattagccaggcgtggtgatgggcgcctatagtcccagctactagggaggctgaggtgagagaattgcttgtactcaggaggcagaggttgcagtgagccgagattggacggctgcattccagcctgggtgacagagcaagacttaatctcaaaaaaaaaaaaaaaaaaaaaaaaaatcaacacagacatagtgctggaaataaatgctctatgagtaggagattggaatgaagtagagagctcaaactgcaatctttccataagcccgggggagatgactactatttaaaagttcaaagttgtgtactgactaacaagcagatcgtaaaactggccagcgtttcaggtttcataaacagtgtggaggctgaaataatgcaaattgctggcaatctatataatagattcttggggaaaggtttgaactatcttctgtttggttacatatgctcattttattattttattttggttttgcatcatttctttttttctgattctagaagtaatacatgtactttataaaaaatttgaattcatctgaaatatgaaaataaaaagtaaaaaacgaccatcatttgctccccagatcccatttattcactccataaataggtactgagtgccttacaagtgccaggaagtgttctaggggctgcaggtacagtcttgagatttctcgacaaagtccctgcccacataaagcttctgtttaggggaagttaagacctgggttgagagtgaaggcgtcaaatattacataagcaaacaagtaagatggtttaggtcatagtaaatgtttcatgggcattaatagggaaggggtacttttcatttggtgttcaggaagcgcttctctaaggaggtgacattttgctgtatcaatagcaggaatccaggcagtaaacgtaaaggccttgtgctagaggaagagacagaaggccagggtggctggaacccagtgagtcagggtgaagggcagatgaatcagagggaagccagactaggtagggccttttaggttgtgattaaaacaaacaaacaaaaagtctgaaatttattctcattgcaggagaaactgctaaaaaattttaatcaagggactaacatgaactgttatgttttttgaggttttttgtttttgagacagggtctcgcttgtcacccaggatagagtgctgtggtgagatctcggatcactgcagcttcaacctcctgggctcaatggattctcccgcctcagcctcctgagtagctggaactacaagttcgcatgcctctagagcccattaaaaaaaaaaaaaattaagacagagtctcgttctcttgcccaggctggagtgcagtggtgtgatcttggcttgctgcaacctctgcctcctgggtccgagcgattcttctgcctcccaagtagctgggattacaggtgcccaccaccatgcctggttaatttttgtatttttagtagagatggggtttttccatgttggtcaggctggtctcgaactcttgacctcaagtgatccacctgcctcagcctcccaaaatgctgggattacagccgtgagccacgatgcccagcagccctgttagtttgtgaatttttggtagagatggggttttgctgtgtttccaggctagtcttgaactcctgggctcaaaagcaatctgcctgtctcagcctcccaaagggctgggactacaggcaagagccactgcgcccagcctggtttttgtttttaaagggtcatgttgggtactagatggggaataagtccatagcggggcaagtgatgatcaatgcaagcagcatttgatatagtccgtgattccttcctaatcaattttattttggagaagtggtggcagtttccttgagtgtgaaaggtgtgacaagggccccatgggttgtcctctggaagatcaagcacctggttaagacttaggagagggaggccgggcacagtggctgaagcctgtaatcccagcactttgggagaccgaggcaggtggatcacctgaggtgaggagtttgagaccagcctgggcaacatggtgaaaccccacatctaccaaaaatacaaaaattagctgggcgtggtggcgcatgcctgtaatcctagctactcgggaggctgaggcgggagactcacttgaaccagggggcagagcttgcagtgagctgaggtcacaccattgcactccagcctgggcgacagagtgagacactgtctcaagaaaaaaaaaaaaaagaattaggagagggatagattctgcactgtctcttgacaggcaactatgtaagttattgcaaaactattatagcagtgatataaatattacaaatatgatagtatctagaatgtactttgaacaagcccaattatttacacagttgagtaatgtctgctcataactttgctcataacattatgttttatttttgcaagagtttcctcctgtgttaattgaagaaaaaattaatcatgcctattcttggactgattagttattaaacacatattaataataatatccattcaatgagttttagctatgaacttgagcttattaaattctcataacagccctatgacataaggagaattattattcccatttaaacatggggaaaccgaggtttcagggggttaagaaacttgctgaaaggcataaagctagaaggtggtagggctggagcctgattctaagccctctctgcctctggatgttcctatccactgtctgttattcttggttcagtgctgggtgctgtagagattagagatggaataagacagaatcccagccttcactcttaaaaggtttacagatttggagtgagagacacagccataaagaacaccacagggccgggcgtggttgctcacacttgtaatcccagcactttgggaggccgaggctggtggatcacttaacatcaggagttcaagaccagcctgagcaacatggtgaaaccccatctctaccaaaaatacaaaaattagccaggcatagtggcatgcatctgtaatcccagctactctggaggctgaggcaggaggatcacttgaaccggggaggcagaggttacagtgagctgagattgcaccactggactccagcctgagcgacagagcaagacctgagaccctgtctcaaaaaaaaacaccacaggctgggtgcggtggctctcatgtgtaatcccagcactttggtaggcccaggcagggaggattacttgagccccagagtttgagaccagcctgggcaatgtggcgaaaccctgtctctaccaaaaatacaaaaaattagctggacgtggtgctagctacttgggaggctgaggtgagagaatcgcttgagcctggggggcccggaagctgtggtgagccaagatggcaccactgtactccagcctgggcgacagtgaggccctatctcaaaaaacaaacaaacaaacaaaaacaaaaacaaaaaatccaccgcaacttataaagcagtataatgaaacacatgctaaatgaaaagtacaagtgtgggccaggcatggtggctcgagcctgtaatcccagcactttgggaggccaaggtgggaggatcacctgaggtcaggagttcgagaccagcctggccaacatggtgaaaccctgtctttactaaaaatacaaaaaattagccagatgtggtggtgcacacctgtgattccagctactcgggagcctgagacacgagaatcgcttgcaccctggaggtagaggttgcagagattgcaccactgcactctagcctgaacaacagagcgagactctgtctccaaaaacaaaaaaaaaagtgtgaaattaggaaagaaattggctgtgactggggagctgcaggccaacagcaaagaggggtgtttgcattgggcctgaaggctaaacagggtttcaaaagaggaagagtgtagagaaggggatttcaggtaagctgtctgccccaggcacagaggtgaatattccaaaggccagggtccaggcaccagctttgtttttttttttttttttttttttttttggctgtttctttccccttggcttaatggatcctgggactgcctggttcacttatatgaatgggcttgggggttggttggaagccagcacaggtaaaggccctcttttagtacttcactcacaagttcccccaaaagatagaatcaattcatttcttcactattcacttgttgtgggcgtctcctgtgcacttgttttagaggaacagagctagatgggtcctgaccccacccttaagaattccgtcctactgtggtccatttcttcctctgctgcttcctagcactgtgatcttggacaattggcctaacttccctaagcctcagtttcctcatctgtaaaatgggtatagtgatttctttaatcccctgagaaataaacagaataatgccaggaaagcatggtgacaaatacatgtcactaaatgttattgatggtagcagtgtgaaggctcagctctgttttgcagacgatatttattgagaaatgcctgccaggctgggtgggaggagctggcctcatagtatgagtacatggtggtcctgcatggaagagcagatggtttctagtttattggttataagtgtgggctttcgagagagcttttattttgaggcctggctctgccatgtcctggctctggactttgaatgagttatttcacctttttttcccccacctcaatcttttgctatctgtatctgttctcaataataaccatgaggaattatataaatctgaagaagtttctcaaagtcagtttttgagacagggtcttgctccattgcccatatgggagtgctgtggcacaatcacagctcttgcaagcctcaacctcctgcctaggcctcccgcctaggcctccgaagtagctggaactacaggtgcacaccaccacgtgtggctaatttttacaatttttttgtagaggtggggtcttggtatgttgcccaggctggtcttgaactcctggcctcaagcaatcctcctgtcttggcctcccgaagtgctgagattataggcatgagccaccacgcctggttatttcacctcttaagctttggtttctgcaactgtacaacagtgacagtaatagtatctacttaggatagctgagaattccttgagacacagattggaaatcattcaatacagaggtcagtacatgatacatgtttagtaaatgttaattattatattattggctttacagctatggcaacaggtacataaaaaggtaaacttgatttaataagggtgtgtgagtaagtagggggctggcagcagggtagctaatggagcaaagaggaggggcttagccaaccctggggcttctgaaaacttctggaagagctgagccttaataagaaagaatagaaggaaatacatatgtggaatcaccattaattgttaggaaaaaccaaattggaaccttactgagatatgtagccactggaaaggctaaaattaaaaggactgatcatactaagtgctggagaggatgtagatcaactggcaccctcatgccttgctggtaggaatgtcacatggggggaaatggcttggtcatttcttaaaaatttaaacatacaccaatcataggacccagacggtgcacttctgggtatttacccaacagaaatgagagcaagtgtctctacaaatatttgtacacaaatgttcatagcagcttttttaggaatagccccaaactggaaacaacccaaatatggtataatcatacaacagaatgcttctcagcagtaaaaaggaacagactaaagacacactatgtaaatggatcacaaaatcatcatgctgagtgaaagaagcaagcaagaaagaaaagagtacatactgtatgagtccgctgacatgaaattattttaaaaacttaaactattgtatacagacagaaagtaagcgagactctaactctacaaaaataaaaataaaaaagttagctgggcatagtggcccacgcttgtgatcccagctacttgggaggctgaggcagaatggcttgagcccaggagttcaagaccagcctgggcaacatagcaagtcctcatctctacaaaaaaataaaaaaataaactggctgagtgtgatgatgtgcacctgtagtcctagctacccgggggctgaggtgggagaatctcttgagcccaggagtttgaggctgcagtgagctatgactgcaccactgcactccagcatgggcaacaaagtgagaccttgtctctaaaaaaataaagaaaatgattataagaaataacatgcatgaagttcttcctatgagccactgtgtgcatgttttacatgcatcctccgctccttacaaaacgttctgtgagatgagacacaatatagccatctattgcatttattgttctatttacagaggagcaaactgaggcttacagaggttaagcaattggcccaatgtcactccactgataagtggtagggctgagatttgaacctagcacaggttgacttaattctgctaccttcctaatttcccaggattagttgaagctgccattgatatagatgcttaatgtcaactagacacatctctgtgtttcttagaactgattctgttctctggctcattaatttccttttccattacaaacatgcctcttgtaagcttgaggactacatctcaccacttcaaagtgccttcagtgtcaaactggagtggaagttgaagacgttcacaaaaatggaggagggagagcctttctgttttgaagacttgtagcttcacaaagaaaggctttctttgaatgatcaagaaggatttctaggtcaatataggggcatattactgtaacgtttggcagcaggagctctgcctgcatttgaatcctggctttaccacttcataatagttgcgtgatcttgggctagttacttaacctctctgaatttcagttttctcatctgtaaaatggggataataacaggatctgccccaaaggatgtattggtccgttttcacactgctataaagatactacctgagactgagactgggtgatttgaaaagaaaagagatttgattgactcacagttccacctggccgaagagtcctcaggaaacttaaaatcatggcggaaggcacaggagaagcaagcaccttcttcacaaggtggcaggagagagtgacagagggaagcaccagatacttatcaaacaaccagatctcgtgagaactcactcagtatcatgagaacagtatgggggaaaccgcccccatgatccaattacctcccaccaggtccctccctccacacatggggattacaattcagattacaattcaagatgagatttgggtggggacacagccaaaccgtatcaaaggctaattaagaagattcaatgaaataatacatgaaagcccttcacagagtctggtgctctcagtaaatggtggcgatcatgttaatagaagaggatgtgaagtgggaattgacctgatagtatctgaatagttggagagaaggaagagagagaagttaaatttaagtgggtgaacctcaaggaagaatggaggtgacgatgagcgtggagatttctggaggcgtgcatgagcttcgctgcattggaggagttgtgagataaaaaggatggttaagcaggaccactagactttggtggattaaaaaaggactggcaatatggggccattggaggacaagggatggagggaaagaagtagcatttatttatttatttatttttgagacagagtcttgctgttgtctcccaggctagagtgcagtggcgtgatcacggctcacttcaacctccacctcctgggttcaagcgattgtcctgcctcagcctcctgagtagccggaattacaggtacccgccaccatgcccagctaatttttgtacttttagtagagatggggtttcaccctgttggccaggctggtctcaaactcctgacctcaggtgatctgcctgccttggcctgccaacgcgctgggattacagacatgagccactgcgcctggccggaagtagcattttaggaaggcttgtctggcaatggtgaccaactggatgcaaagtcaggggccctggggataagaaggtcagctaggagggtttggaattatcccatgatgagggctgtatgtccaaatatccatggcagggctggagtctgcaggagcagtgggtttgaaagaaggggctgatcagaaatcttgaagggagaaacccatagtagttattatgtctcagaaggaaagaaggtcttctaagtgctctcaatgtgataggcaaggaaaaaccctgtcattagcctgaggtcttaaccagttaaaaatatcagcatccaggcgcagtggcttacgcctgtatttgcagcactttgggaggcccacgcgggtgggtcacttgagttcaggggttcaagaccagcctgggaaacgtggcgaaatcccatctaccaaaaatataaaaattagctgggcatggtggtgcaagcctgtaattccagctactcaggaggctgaggcatgagaatcgcttgaacctgggaggcagaggttgcagtgagctgacatcgcactactgcattcaagcctaggcgacagagcaagaatctgtctcaaaaaaaactgaaaaaacaaagagttgttcctgatgctgccgtgagattagcatcctcgccttctgctttgagggaaagatgtgagattttcagatcagatacaaagtaacaggaataggtaccatgaatgggaaccggcagccaagtgacagtgttgtgatgggtataggctgggctaggtactttacacaccttaaatttttgattcttagatgccagcataggtgaggtataacatttcagagtaagtcacgtctttctgaaacaacagaaacaaaaaaacgataaggccccgttaaataactggtccgtttagcactacctgcaatagcaaagatgtggaatcaacctaggtgcctattgacagtggattggataaagaaaatatggtacatatataccgtggaataccaccagctagcaaaaaaagtaaaactatggtctttgcagcaacatggatgcagctggaggccattatcctaagtgaactaatgcgtgttctcacttataagtagaagctaaacattgggtacaaatggacacaaaggtgggaacagcagacactggggactacaagagggaggaaggagggagggaagagttgaaacactacctgttaggtactttgctcattatctggctgatggtttcacccagaccccagatctcagcatcatgaaatacacccttgtaacaaacctgcacatgtacctccttagtctaaaataaaagttgaattttttttctttttctttaattttttttttttaagagagggagtctcgctctgtcgcccatgctggagtgcaatggtgtgatctcagctcaatgcaacctctgcctcccaggttcaagcgattctcctgcctcagcctgctgagtagctgggactacaggtgcacaccaacacacctggctaatttttgtatttttactagagacaagctttcaccatattggtcagactggtctcgaactcctgacttcaggtgatccacccatctcggcctcccaaagtgctgggattacaggcatgaaccactgcacccagcctactttatttttaatctccatctagtatttagactagagatgggcaaatttttcttttttgttttctttaaaatttttttttttttggtagagatggggtctcactatgttgcccaggctggtcttgaactcctggcctcaagtgatcttcctgccttgacctcccaaagtgctgggattacaggtgtgtgtcatcacacccagccctgatacactttttctgtacaaggatagatactattttagggtgtgcaggtcatatggcccctgttgcgaccactcagctctaccaccgtactccaaagctgtagcctaaagctgccatagacaggcacctaagtgaatggatgtggctatgttttgtttcagcttgattggtgagcactgaaatttgaattttatataactttcccatgtcataaaatattattattcttttgatgttttcccacagccatttgaaaatgtagaggtcatctcaaaaaagaaaaaaaaggaaaagaaaatgtagaagtcatccttagctcaagggccatagagaaactggcattggtctgggtttggtctgaaggctcatggatccctaccctagacaaataataggcatgtaaaaggtattcacatcacagctggctttttttttgaaacagagtcttgctctattgttcaggctggagttcagtggcatgatcttggctcactgcagcctccacctcctgggctcaagcaatcctcctgcctcagcctcccgagtagccgggattacaggcacaagccaccatgcctggctaattgttgtatttttagtagagatggggttttaccatgttgttgaggctgatctcgaactcctgggttcacaggattcatctgcctcagcctcccaaagtgctgggattacaggcatgacccaccacgcccggccatagctggctttttgcttgctgtgggaggagaaagttctggctgcttggcttcgatgctatgcttggctcttccaaccaccatttgtggctttttgctgccagagcttgtcatgctgctgcattgcccaagagaaaaagtttgtgaggttccacgttccatcatatcgatgatcattttagggttttcacacacaagagacaggattattgcaagcaacagcaatgaactttggaaaactcagaggttttccaagtgtgagatttaaagcctcatgcatgaaactttaaattagtttaagggggcgtaaccagcataaaaaaaatgaaatagaaggaaataggaaatagaaagctgcatctatgctgctaaagttaagtcttatttccgtgcaacctttcgtttgtttgttttgtttgttcgttttctgagacagagtctccctctctggagcgagtctcacccaggctggagtacagtggtgtgatctctgctactgcagtccctaccttccgtgttcaaacgattctcctgcctcagcctcttgagtagctgggaccacaggtgcatgccactatgcccagctaatttttagtagagatggggtttcactgtattgaccaagctggtctcaaactcctcacctcaagtgatccacccatctcagcctcccaaagtgctgagattacaggcatgagccaccatgcccggcctattttgtccaacgtttgttttacttatgcctatgtgtgtatgtacatactgggtcactcttagtatttcttttttttttttttttttttttttgagacaggagctcactctgttaccgaggccagagtgcagtggtgcaatcatggctcactgaagccttgaattcctgggcttaagcgattctcccacctcagtctcctgagaagctgggactacaggtgggtgtcaccacacccagctagctaactaatttttttttttttttttttttttgtagagacagggtcttactttagtgcccagactggtcttggactcctgggctcaagtgagcctcctgcctcagcctcccaaagtgctgggattagaggcatgagccactgcatctggctctctgagtatttcttactgtgatccacagtaagtaaacttatttaaataagtttgcaaagtacaggaacttaaggaaaaggaatgtatctggaaatccttccagaatttaaaacaaaaaatagctctaggcacagtggcttacgcctgaaatcctagcactttgggaggctgaggcgggaggattgctagaggcaagagtttgagaccagcctgggcaacacagggagatcccatctctacaaaacagttctaaaaattatccagtcatggggcgtgcacctgtagtcctagctacttgagaggctgaggcaggaggattgcttgaacccaggagtttgaggttacagtgagccatgattgggccactgcgctccagcctgggagacagagtgagaccctgtctcttaaaaaaaaaaaaagaaaagaaggaaggaagggagagagagggagggagggagagagagagagagagagagagaaagaaagaaaaagaaaaagctaaacagccagaccttagagagaagaggaaccttggtgactaggaatttccagatggcagaaaattccgggtactgtcatctggctgaatcagtcccactcttttgcatctctgagccactgtgcccaagattcaagtacctgggggagaacacagagaagatctctgcgttaaccagagtccatttctgttgcttgcaaatcatcccatctcctgtgtgtgcaaactcctaaaataagcacttttagaagaaacgctgactcgtacaaactttccctgtgtcctaaggcctcctgccagctttgcaactgctgctcgcgggcaagggaacctctccagtctcaggacaatggtggttgggagaagctaagctaaggtcaaagccaaacacagcgagaacttagcctaagtgtatcggaccagctaggatcaagacccaacccttgactaggaaggagggcatcttgaatgccagttccctaagacagcatttcacgggtgaggtgtattctcccatggcaagacattggaggtgctatcatgagagaaagaacaatggatgcttgcagaacagaacccgcagatgaccactaaggaatgacactggttttccttctctaataaaaataacaacaacaacaacaaaaatagctgggcgtggtggcaggtgcctgtaatcccagctactcgggaggctggggcaggagaatcacttgaatccgggagacggaggttgcagtgagctgagatcgcaccactgcacaactacctgggcaacagcacgagactctgtctcaaaaacaacaacaacaaagaaaaaaccaaaacaccgttgcttttattctgataataaaacagggttaatgctcgaaattttaaaactaaaaaaataccaaaagttataaaagagggcaaatgtcatttaaaggaatgctgcagcgaggtagagtctcacacctgtaatctgaggcagaaggcaggagcttgagcccaggagttcaaggccagcttggccaacacagcaagaccctgtctctacaaaaataaaaataattacctgggtgtggtggtgtacctctaattctattattagctacttgggaggccaaggcaggaggatcacttgactccaggagtatgaggctgcagtgagccaagactgtgccactgcactccagcctgggcaatagagtgagaccctgttctaaaactaaccggctgggcgaggtggctcacctgtaatcccagcattttgggaggccgaggcgggcagatcacttgaggtcaggagttcgagaccagcctggccaacgtggtgaaaccctgtctctactaaaaatacaaaaaaattagctaggtgtggtggcacgtgcctgtacacccagctacacgagaggctgaggctgaagaatcacttgaacctgggaggtggaggttgcaatgagtcgagatttcgccactgcactccagcttgggtgacagagctaactctgtctcaaaaataaaataaaataaagcaaaccaacagaatgccaccaacctccaataaccactgagagcatcccttcagatgtcccttcctcccttcccctttccttcctctcctcctcttcttcctgttctgagtcatgtttctcaaggagagacaagttgtactttgggatctggtctcttttctcacacatctctgctctctaggggggcacctccctccctatggatatcacagggagtttttttccttttagagtttgaatggaggaagacttcagacagaactgtacacagcacagagctgcagagaagtggaagattaagagaaaataatgttggacaaattagatgtagcttgtataatctggagctacagtcacgagaataggatgtaacataaagtctaatgtgattcagcaaacacacgttttcattacttttgtgcagatggctctgctaggtgacttggaagggaaggaaaccgaggcagtgttgcttccttcgaggaagacagagttgcttcctttccccccatccactggggacagaatttcaaagagattacagcacagaccagcctgtggcaaatgcatgagccaagtgtgatggggacacagaggcgattaaaatgcaatcattagggctggtcatggtggctcacgcctgtaatcccagcactttgggaggccaaggcgggtggatcacttgaggtcagcagttcgagaccagcctggccaacatggtgaaaccccatctctactaaaaatacaaaaattagccggtgtgatggcacatgcttttagtcacagctactcaggaggctgaggcaggagaatcgcttgaacccagaaggcggaggttgcagtgagccaagattgtgccactgcactccagcctggatgacagagtgagactcagtctaaaaaaaaaaaaaagattgctgttctatttatgctgtgaacattgctgaaagattgagcaggaaaaatggagatcaatgctcagtaagttccacctgaaagacctcctttgaacatagcaactgttcacttggtgaaatttggctatacaggtaatgaatactttgtgagaaatcacactctgtggtctccgagtagcattaacaatctcttgcaacagagaaagctgaaatgaagaggagaagtgtagaaaatgtcatctgagggcgcgcgtggtggctcatgcctgtaatcccagcactttagaaggcagaggcaggtgacctgaggtcaggagttcagcctggctaacatggcaaaaccgtctctactaaagatacagacattagccgggcgtggtggcgtgcacctataatcccagctactcaggaggctgaggcaggagaatcacttgaacccgggagatggaggttgcagtgagccgagatggcgcaactgcactccagcctgggcaacaaatggagactctgtctcaaaaaaaaaaaaaagaaaagaaaagaaaatgtcatacccaacagtgtgttgggtatgacaactactagtgtgtccagccatcctggtttgcctgggactatcctatttttagctctgaaaagtctttttaaaattttatttatttatttatttttgagatggagtctcgctctgttgcccaggctggagtgcagtggcatgatcttggctcactgcaagctccgcctcacgggttcacgccattttcctgcctcagcctcccaagcagatgggattacaggcatgtgccgccacacctggataattttgtatttttttagtagagacagggtttctccatgttggtcaggctggtctcaaactcccaacctcaggtgatccaccagcctcagcctcccaaagtgctgggattacaggcatgagccaccgcgcctggccatgttaactatatattaagatacgaaacagctttctttcaaggggtgcagctttaaaacagtctacagtagcaaggcatttaacctgtactcggaagccaggaaaccttggcctgacttgccactgtgttctttgaaaggtccgtcgttaatgtttgactattcttaatgacaatttgtggcttatcaggttgacgttttcctttcttttcaggcagctgagacttaagggagtgaagtaatttggtggtattcattgcaggggccacatagatactgtcagtacgcttttaaaaatctttttaaagtaatagatgctcattataaaaattcaaacaatacaaaagtgtagaaagtagaaagtactttctacttcaggaagaaaatttcccaccctcaaattgtcattccgtcacaagtttgatgtgtatcttctcagtgttttgttggacatatgttaacacatggattttaaaaaatgaattggatgatatgtgtactaatcagtcttctttttttattcaaactatatatcatgaccatctttctaagtcagtaatacagcattatcttttccttgttttttttttttttgagagaaagtctagttctgtcacccaggctggagtgcagtggtataatcatagctcactgcaacctctgcctcccaggttcaagtgattctcatgcctcagtcacaggagtagctgggactacaggcacatgccaccacacccagctactttttgtattttttagtagagactgggttttgccatgttatccaggctggtttcgaactactggcctcaagtgatctgcctgcctcagcctcccaaaatgctgggaagacactgcatcagccaaaaaaagtatcttgtgtttaatttggcctatgtcttccttttctgatcactgcataatttttcagtgtctggttataccttattttttcttaattaattctttattgatggacagctaggtgatttaacaatttgataaagaatgctgcaataaatatcttttgtcatttttgcacattgtccaattatttcctctatataaattcactttttttttgatgcggaatctcactctttcgcccaggttggagtgcaatggcgcaatctcggctcactacaacctccacctcctgggttcaagcaattctcgtgtctcagcctcccgagtacctgggattacaggcacgcgccactatgcctggctaatttttgtatttttagtagagacagggtttcaccatgttggccaggctggtttcgaactcctgacctcaagttatccacccaccttggcctcccaaaatgctgggattgtaggcatgaggcactgtgcccagcctcctctatacaaataattaaaagtagaattgctgagttaaaagctttcaactaggtttagaatgtggaagatacacaaatctgaattcactttatggggtgcatatttgagactaaattaaaactaattaacttgaggaagaaagaaaatatcgtaattcaaatgatactgtggaaaaagtagcagagtaggagttagaatactttggttctagagcttgttcaccttccagctaactggttgacctttgacaagcttcttaacctttttgcacgtctgactcttgcctccagttgtatctggtctcatgaatcttccaaataattgacagagtcattttctacaatgcgaatatgacctctgcttaagtccatcaggagctcaccattgcctttggggtgaagctaaaactcctagctaaccatgcagcagtctgtgtttgtagcttcctctccctccacgtgcccagccaggacctttgatccacctgttctcacctcctttcattgccttcaatgctcacagtttgctaagcctccagatgttggttcaggttgttccctccttctggaatatctggtcccttctctgaccagctgacttctactcattcttcaagaaatagcttggactttgtattagtccattctcacgctgctataaagaaatacccaagattgggtaatttataaaggaaagaggtttaattgactcacagttccgcatggctggggaggcctcaggaaactaataatcatggtggaagagaaagcaaacatatccttcttcacagggcagtagaagagaaagaacgagcaagaacagggaaaactgccttaattaaccatcaggtctctcgagaattcactcactatcacgagaacagcatagggaaaaccacctccatgatccaatcacttcccactaggtctctccctcaacacctggggattacaattcaagatgagatttgggtggggacacaaagcctaaccatatcagacttcttaccttctcagaagactttcctgacacctacaggttgaactgatgcctcttctcttggcttttgtgaaggcagcatattactttacacatcctctgtaaatagcacacactgtattacaacggctgactttcttatctgggtcacttcattcttttgagggcagaaaccgtgacctgttcatctttgaatttatagtatctaccacagtgtctgacacatacagatgtttgctgaatctttgtggaataaaacaattgatctataaaataagtgattggattcagtaatacaaaattgcagccaagtatggtggctcacacttgtaaccccagcactttgggaggctgaggtgggtggattacctgaactcaggagtttgagacgagcctgggcaacatggtgaaaccccatctctataaacaatatgaaaaaattagctgagtatggtggtgcacacctgtagttccagctacttggggggctgatgcaggaggattgtttgagcccagaaggtcaagactgcagtgagctgtgttggcaccactgcactccagcctgggcaacaaagtgagaccgtgtgtccaaaaaaaaaaaaaaaaagtagaagtttatgagaattaaaagttcaaggaaacctcagaactactaaggaaacatctcaaaataatacagtaaaaaaaacacaaacaaagccaggtgcggtggctcacgcctgtaatcccagcactttgggaggctgaggcgcgtggatcacgaggtcaggagtttgagaccagcctggccagcatagtgaaaccccatccctactaaaaatacaaaaaaattatccgggcgtggtggcgggcgcccataatcccagctactcgggagggtgaggcaaggagaattgcttgaacctgggaggtggaggttgcagtgagccaagatcgcgccactgcactccagcccaggtaacagtgtgagactctgtctcaagaaacaaacaaacaaacaaaacacacacacaaacaaacaaaggaattaaaatggcacactggaaaataacatgaaagaaagctattaaaaaggaacagactaacaaaaaagacatgaaggatataaaaaacaaatagcaaaatgtcaggtgtaaatccaaccacatcaataattacataaatgcaaatggattaaatactccaatcaacaggcaaagatcgtcagactggattaaaaaaaaaaaaacaccaggatccaactatgtattgtctataagagacacacttcagattcaaagacacaaataggttgaaaagaaaaggatggaaaaatgtatagcctgcaagcataagagagcaggagtggctatattaatatcagacagaagaaaatttaagacaaaaaatgttactagagacaaagagggacattttatagtgataaaaacaacaatacaacaattatatatgtgtccaataacaagagtagaagggaattgtagaatgaattatagaacctttacagtgtgaatattgtaacttacagtgtgtaaattacagtgtgttttcagaaccataccttggaacctctccagattctttaccttgtggcctcctgtccactccattctaaggtgttatcatactgaagtgcaccatagtggtggtcttgatggggaaaagaaatcacagtagcactaacaggaaacatcctgagggaagaggcactgtcatttttaggtgtagggaagatgtttaagagcccgttttaaacatctgagcttctggtctttggaattttgtcagcccagagacagtttcttttcttctcaattctcttttcctttaattggtcttcttcttgccatacctcattccttagtcatcctggtcttgatctcagaaatctcacattctcattgatttagcatggttttctactctagtgccagttctactgttggatggaaagaaccatcttctgatgtgacaggaagccttaattattaatttaaaattcccctacccttctccaacttctatggaagttaactcaggaattattggagtaggttgaagattctctgagtgggaggatgggtgagattcaaattagagaagtactatgaggactaaatgaccctacctaagaaagacagtttccaaactaaagttatgggagttgggtacgtaggtagggactcgggaaccatcttggctagagaagggtcagaggaaaaatacagaggaaattcatgggagagagtatcagggtggatatatacggaacagatgcatacttcaaggggacatttagacattttgctctgggatgagcaaaatcaccctctttttcatctcccaacaaaccatttaataaaaagtaagacattactcattatcggagcaggatctgttgatttcgttttttaatttttttaattcatttgtgtttgatgtgatgatgtgccaagaccagcctgaaggtggccaagggcaaaagcagaggttgttatttgcaggctacgttgacactaggtagtgaacttcacagctcaacacatccacacatattggctgaacgttaattagttctgcctagttacagggtttccaaaatggatgagacattctgcctcccctcaaggaatttgtgggctggtaaaggagacagacacagtaacagatcattatgtaatatgctaagtgctttatcagaggaaaaaagctgggtgcaggctgggcgcagtggctcacacctgtagtcccagcactttgagaggccaaggcaagcacctgaggtcaggagtttgagaccagcctggccaatatggtgaagcccattttctactaaaaatacaaaaaattaaccaggagtggtggcacatgccggtagtcccagctactcgggaggctgaggcaggaggatcgcttgaacccaggaggcagaggttgcagtgagccaagattgcaccagtgcactccagcctgggtgatagagcaagactctgtctcaaaaaaaaaaaaaaagaagctaggcgcatcaggggctttgagccttctgacccagcctgggaacagggagaagcacaattcaaggggacatttagacattttgctgtgggaggagcaaaatcactcctggcaggagcgacccccgggctcagttcaccaggtgaaaggaacaggcaaagtcacataagtacaaagcagtgtggtgcttcctgggaccaaaaagcaattcgttatcaataaaacatactttgcgttggttcccatcttaccgaaccttctttcctttcttctttcttccctgcttccttctcacacgccctccactcacctctcagaactcattctatgtgatctctacccaaagcacagtgctaagagcccggaataaaacgggcaaaaccaacctagccattgtcctcatagaattaatcatacaaataaaaatataattttaacctgtggcaagtgctcagacagaaaaaatccagttaggctgccagtaaaaatactagatgtggccggatgtggtagctcatgcctgtaatcccagcagtttgggaggacaaggcaggtggattgcttgaacccaggagtttgagaccagcctgggcaacacagcaaaccccatctctacaaaaatacaaaaacaaaacacaaaaattagccaggtgtggttgtgtgcacctgtagtaccagctacttgggaggttgaggcaggaggatcacctgagcccaggaggttaaggctatagtgagctgtgattgggccactgcactccagcctgggtaacaggaagaccctgtttcaccaaaacaacaacaacaacaacaacagcagcagcaacaacaaacaaaaaactcccccaaacaggtgcccagttaactttgaatgtcagataaacaacatatatgattttgcagtataagcatgtcccatgcaatatttgggacatacttatcctacacaaaaattgttttttctgtgaaattcaaagttaactggatgtcctgccttttttttttttttttttttttttttttttttgaggtggagcgtcgcactgttgctcaggctggagtgcaatggcgccatcttggctcactgcagcctccacctcccaggtttactagattctccagcctcagccccctgagaagctgggattacaggtgcccaccaccacgcctggctaatttttttgtatttttagtagggacagggtttcactatgttggccaggctggtcttgaagtcctgaccttgtgatccgcccgccttggcctcccaaagtgctgggattacaggtgtgagccaccacacctggcctgcatttttatttgtaaacctggcagccttaagtccaagatcccatgagctcacatgactaggggacctgagttaacctgggctgcagtgggagaaggtgattggagaaagcctgacatctgcagaacagggagctgcacctgggagaggaggccggagaggggagtgacctggagaagggaacagcctgaatgcgaacagaaattggccccaacagagcgttcaagagtctgagagaaggctcctggggcttgagcacagacatttagtttactgggatatggagagaggagaagcaattggaaaatgagtaaatatatcatgcttttaaggaggcatgctgtacaagtaaatgtcaggtacagtgactcaggttattgatttgaaagattagtcagtggagacatgtgctggacttactcagtccctctgttgtcaaggaagtccaacgccaccagcactagatccttcaacaatgcagagtcctcccgcaaatgaatctgactttgcctgtaaaccgcggagagtttcaaaaactggaaagcattacaggtggccagtttgtttccatttatataaagtgcagcaaaaatgatctgtcagagagagaacattgggataaatttcttttttttttttttcttctggagacaaggtcttgctgttgcccaggcaggagtgcagtggtgcgaccatggctccctgcagctttgaactcttcatcttaagggatcctctcacctcagcctcctgagtagctggggccacaggtgtgcactagtatgtctggccaattaaatcaattaaatatatatatattttgtagaggcggggatctcactatgttactcaggttggtcttgaactcttggtcccaggcaatcctcctgctttggcctcccaaagccctgggattgcaggcataagctacatcacctggcctgaaatacgcttgaaggcatcctttgaaccactgttatcacagaagtgtggtcaggttcagtgtggagagtgaatgagaagctgggcaggagcctgtgcgagttgggctttgtggagacacacagaaagatgccccccactttaaccaccttcccttgcctcgtcgtttgactgctgaggtcttactcacactctgagactgtagctttcacgtggcctcctctaatatattttcagtgtagccttaacaatgaatcgtagtaacttctcaccttacatgctccccaaaagatgtcactttgggagaacatattcaaggaaccctccccaatcctgacccccatccccaccccagctcctgctgctgttgacacaactgccttagctgtgaggctgtgccatccattggaacctgggactttccaatgttgggatgcctcagcatcatcaagcaaaattggggttctttttgtgtatgctttaaaaaaaaaaaaaaaacttgaagcataaaactattactggaaagtggtcctgatccagactgcaagagagggctctcggatcttgtgcaagaagaaatttggggcaactccatagagtaaagtgaaagtagtttattagagaagtaaagaatcaaggccgcgcacagtggctcatgcctgtaatctcagcagtttgggaggccgaggcgggcagatcacctgaggtcaggagttcgagaccagcctggccaacatggcaaaaccccatctctactaaaaatacaaaaattagccaggtgtggtggtgggcgactgtaatctcagctactcaggagactgaggcaggagaatcacctgaacctaggaggctgaggttgcagtgagctgagattggtccactgcacttcagtctgggcgacagagtgagacttcatcttaaaaaaaaaaaaaaaaaaaaggattccaaagaatgtcaggtatggtggctcatacctcccagctctttgggaggccaaggcgggaggattggttgaggccaggagttcaagactacactggccaacatagagagaccctgtctctaattttttaaaaaagaagaaactaaaaaaatggcttctctgtaggcagagcagtctcgagtgctgctggttgacaattcttgtggttatgtcttgatcgtatggtaaacaagaggtggattattcatgagttttccggaaatggcacagggaattcctgaaactgagaattcctcttccttttagactatattgggtaacttccagaagttgccatggcacttgtaaactgtcatagtgctggtgggagtgtcttttagcatgctaatgcatcataattagtgtataatgagcagtgaggatgaccagtggtcacttctgacaccatcttggattgggcaggttttggccagcttctttattgcaccctgttttatcagtggggtctttgtgacctgtatcttgtgacctcctgtctcatcctgggactaagaatgcctgacttcctggggttgcagccaagtaggtctcagccttattttacccttattcaagatggagtcactctggttcaaatgcctctgacaaagccagcatagatgaagacctaacacccttgagcaaatgaaagatctgtgtgatggaacagttgcgtgtcttgattggggtggttggttacctgaatctgtacatgtgataaaattgcacagaaccacacacacacatacacacacacaccaatgaattggatgtaaaactggtgaaatctgaataaggtcagttatgcaaaatgtcatcactggggaacattgggtgaaggttttttaggacctctctgacatacaaacggatataaatcagcaattctctccaaataaaaagctaaacaacaaaaccgaccccaaacactgacaccttgtatccatcatccaaatttggtcaatgctaagatatatatttttttttttttttttgagactgggtctcaatgtgtcacccaggctggagtgcagtggtatgatctcggcttactgcaaactctgcctcctgggttcaagcgattctcatgcctcagcctcccaagtagctgggattacaggcacccaccaccattccaggccaatttttgtatttttagtagagacagggtttcaccacgttggccaggctggtctcaaactcctgacctcaggtgatccgcctgccttggcctcccaaagtgctggtattacagctgtgacccaccgcacccagccctaagatctttgtattagtcctttttagaaaaataaaacaaaaccttaaagattcagctggagactcctactcagtcctttttctttccagaaatgacccttgtcatggaattaatatgtatttatcttttccacatttgcttttactgtattatgtgcatagtcataaacaatctgtgatatcctgttatacatttcctttggtagcttattttgccactaaacatgttttcaggatttatgcatgttgaaacatgtagatcaattcttttaattttttaactgctcaaagtatttctaataggtgaatataccacaaattcttcaaccaatcttccactgataataggttgttttccatttttcagtattaccagacattgctatcatggccatccaggtataaatgcctttttgggtcaagagtttctgcagggtttttatctagaattgaaagtgctaagcagacagtatgcacatactaaacttcagtaaacattgagaaattgctatccaactgtgactctataaatttatggctgtcccagcaggtggtaataatcaccatttccttatattttcaccagccaacctgatctttccagactgttaaaagtttgccaatctgatggatgtaaagtagtatttcattgttattttattattgtgttttcctgatttccaatgaggttagacatctcttcataggtttattagctggaatttcctcttctgtgaatcctgaggtcgtacccttttgccctttttttttctattgtgttgtcattgtcataggtattttttgtattttgttcccgattgttttgtatgtttgtgtattataaatttcagcttgtggcctgtcttttaaaaaaagactttttattttgagattattgtagtttgcgtgcagttgtaagaaataatacagagatctatgtatgcctttcacccattttaccccaatggtgacattttggacagctaaatacagtatcaaagacaggaaattgacattgatacaatccattcatcctattcagatttcaccagatttatgtgtgtgtctgtgtgtgtgtgtgtgtgtatttagttctatacaattttatcatatatttagatttgtgtgactatcaacaaagtcaagatacagaacagttccatcacaaaggttcctcctgctacttttgtatagttacagttaccttgccccattcaacccctagcaacaacaattagttttctatttccataattttgtcatttcaagaatattaaagaaatggaatcatgcagtatataacctttttgagattggctttttcactcaccgtaattctctcaagatccatccaagttgctgtgtgtatcagccattcattccttttcattgccaagtaatattccattgtatggatgtaccatggtttgttttacccattgaaggacatctggattatttccagttacaggctattatgcttaatgctgctatgaatactcttatgcaaatttttgtgtgaacataagttttcatttctctgagataaacgctcaggagtgcagttactgagttgcttcaaatgcatatttagccttataagaaattgccaaactattttctagagtggttgtaccatgttacattcccattggcagtgcacaagggattcagtttcttcccatcctcacctgcatttggtgttatcattattttttattttagctagtctgataggtgtgcagtgacatcttgtggttttaatttgcattttctttatatctaatgctgttgcacatctttttatgggcttatttgtatgtccatctgtataatctcttcagtgaaatgcctgttcatgtcctttgtccacttactaattggtttatttggggtttttctgctgttgacttttaagagttctttatgtattctaaatacaggtccttgttgggtatgtggtttgcaaatatttcctcctagtccgtagcttgttttttcactttcttgtcaatgaagagtcaaactctgtaaaatatttgaagatacttattctgagccaaatggaagtgaataatgacctgtgacacagccctcaggagatcctgagaacatatgctcaaggtggttgggccacagcttggttttaaacattttagggagatacaaggcatcaaccaatatatgtaagatgtacattgatttggtccagaaaggcaggacaactggaagcaggaactttcaagtcataggtggattcaaagattttctgactggcaattgattgaaggagttaagttattgtctacagactgagaatcaatagaaaggaatgtctgggttaagataaggggttgtggagaccaaggtttcattctgcagtcaaagcctctgtgtagcaggattcagagagaacagattgtaaatatttcttttctttttttttactttttcttttcttttctttctttctttcttcttcttttttttttttttttttttttttttttgaggcagggtctcagtctgtcaccaagtctggagtgcagtggcacgatcacagctcactacaaactttgtctccagggctcaagtgatcctcccacctcaaccttccaagtaactgggactataggtgtgcacctccccacctggctaatttttgtattttttgtagagatggggtttggctgtgttggacagactggtctcaaactcctggcctcaagtgatccacccacttgtcttcccaaagtgctgggattacaggcatgagccaccacacctgacctgattgtaaatgtttcaatcagacttaaagagtctgttctattaataattccaaaaggaaggcaggtataatgaggcatgtctggctctcccttccaatcatggtctgaatgactttttcaggttaactttgacatgcccttggctgagaggagggctccattcagatggttggggggccttagaattttgtttttggtttatactcttcacagactcttttgcagagcaaaggtttttaattttgatgaggtctaatttatcaattttcccttttatagattatgctttggtgtcaaatctgggaactctttgcccccctttaggttcttaagattttcccttgttttgttctgaaagtattatagttttacattttacactaagtctgtgaatcattttattttttgtgtaaagcatgataattaggtagagatttatttttttggcctgtggatatccaatttgtccagtattgtttgttgaaaaggcttgacttcctccaataaatcatcttcacacttttttttttttttttttttgagacagatccttgctgtgttgcccaggctggagtccggtggtgcagtcacagctcactgcaacctccacctcctgggttcaagtgattcttgtgtctcagctaagtagctgggactacaagtgcgtgccaccacacctggctaacttttgtatttttttagtagagacagggtttcaccatgctggccgggctggtcttgaactcctggactcaagcaatcctcccacctcagcatcccaaagtgctgggattacaggcatgagccactgcacccacccttcgcacctttgtgaaaaataatgtgggcacatttgtttggggctatttctggattctctgttctgttccctcaatctatatgtgtattcttccaccagtaacacagtaacacagtcttgttaaagtaagctgtaggtatatgtaatcatttgtgattccttccagcttattcatatttctcaaattattttagctcttacaggtcctatgcctttatatataaaatttagagtaatatcgtttatgtcttcaaaaattaccttgcaggggtattgataggaatagcattaaacctacaggtcattttgagtgtaactgatatctttactatgtggagtttgccaatccatgaacacaatatgtctcccgatttattgagatattcttaattctttcttcagaattctgtaaatttcagcatacatatcctctacatattttgataaatttatatttaggtatttcattttctttggagtaattataaatggtaatgtgtctttaattttggtttccacatgttaattattagtatatatagatgcagttcatatttgtctcttgacattggatcttgcaaactttctaaactcttgtattagctctaatagttttttggtaagttattggagatctacgtagacacttaagtcatctgcaaatagggacagttttatttcttccttcctaatttgtatgccttttatttctttttcttgttttattgcactggctagaacttcagtactatattgaatgacagtagtgagagcagacattcttggctttttcccaattttagggagaaaaaaatcaggttctcaccattaggatgttagctgtagttttgtgtagatacactttattaagttgagaatgttctcccttattcctactttctgagactttttgtactacatgagtgttggattttgtcaaatgctttttctgcatcaattgatacaattgtatgattttttatttttaccttgttaatatagtggatcacacattgattgattttcaaactagctttgcatacctggattgtcccacttagttgtggtgtataattcttttcatccatcattgggtttgatttgctagtatttttagtattttgttgaaaatttttgctctaagttcatgaggaatatattggtctgtagttttcctttgttgtactgtctctctctggttgtggtatgacggtaatacaagattcataaaatgagtgatggagtgttcctttttctttctttctttcttttttttttttagacagagtctttctctgtcgcaaggctggagtgcagtggcgcgatctcagctcactgcaacctccaactctcaggttcaagcgattcccctgcctcagactcccaggtagctgggattacaggcacatgccaccacgcctggctaattttttgtattttagtagagacggggtttcaccatgttggccaagatgatctcaatctcctgacctcatgatctgcccactttggcctcccaaagtgctgggattataggcatgagccaccgcacctggcctcttttttttttttttttttttttttttttggagagggagtcttgctttgtcactcaggctgcagtgcagtggtgcaatctcggctcactgcaacctctccctcccaggttcaagtgcttctcctgcctcagactcccgagaaactgggactacaggcgcctgctgccacgcccagctaattttttgtattttagtagagatggggtttcacgatgttgcccaagctagtcttgaactcctgacctcaagtcatcctcctgcctcggcctcccaaagtgctaggattacaggcgtcagccactgtgcctggccaagtgttaccttttctattttccacaaaagattgtgtaaaatatgtattaattctttaaagatttgatagaattcttcaatgaagaattgatagagattcattttttttggcctatggatgtccaatttgtccagcgttgtttgttaaaaaggaataatttgaaagctcacaaagagaaatatccaggcaatttctggagatttctcctggagatttctcttttgggagtttttaaattatgcactcattttccttaatggttttagaactatgcagattttctaattcgtcttggatgagtttggtagagtgttgtttttgaggaattggtccatttcattaagttgtcaagtttctgcgtaaaaagttgtttgcagtattcccttgttatctactcagtggctatagaatctgtagagattatcacctgtttcatttctgatattagtgctttgtgtcctctctctcactctctctctctgtctgtctctttttagagataggggtcttgctgcattacctaggtgagacttgacctcctgggctcaagagatcctcctgtctcagcctccaaagtagctggaactacaagcatgcaccaccacgcctggctaattttttgtagagatggggtcttgctatgttcccctggctggtctcgaacttctggactcaagcaattctcccacctcagcctcccaaagtgctaggattaaaggcatgagccactgcacccagccctctttcttcatataagcatttagtgctattaattttacactgagtacagtctctgtatcacatatgttttgatatgttgtattttcattttcatttggttctattctttaagttttgttttagaattcttctttgacctagagattatttagaagtatgttgtttaatttccaagtgtcaggagattttctgttatatttctgttattgatttctggttttgttccattatggtcagggaatataacacataattttaattcttttgaatttgttggggattgttttttggccggggtatggtctatcttggtaaatgctctgtgaacacttggaaaaaaatatgtattccactgttgttgggtgaagtgttcccaacttaaatatcaattaagttgaatgttatgcagttattctatatccttgctgattttctgtctagtaagtctaccagttgctcacagtgggatgttgaagtgatcaattgtaactgtagatttgtgtacttctcctttcggctttatgaatctttgtttcatgcatcttcagactctctgttgtttggtgcatacacaggattgctatgtcttcttgataggttgacccttttatcatgatgtaatgtctctctggtaattttctttgctttaaagtctactttatctggtattagtagagccatcctggcttttcttttgattaacatttgtgtatctttttctatcattttactttgaatctgcctatatcattatatttgaagtgagtttcttctagataacatattgctggataatgttttcatgttcattttgccaatctgtctttaaactgatatatttagaccatttacatttaaggcaattattaatgtgttaggatttaagtctgccattttattgtttgtttctcctgtttttccttctctgcttctcttttcctactttcctacaggttacttgacatattttaaggattccatctttttttttttttttttgacatggtctcgctctgttgcccaggctggagtgcagtggcatgatgacttggctcactgcaacctttactttccaggttcaagcagttctcatgcctcagcctcccaagtagctgagatcacaggcatgcgtcactatgcctagctaatttttgtattttcagtagagatgaggtttcgccatgttggccaggctggtctcaaactcctgacctcaggtcatccacctgcctcagcctcccgaagtgttgggattacaggcgtgagccactgaggccagccagattccatctttaaaaaaaattattattgatttttgtgggtacataagtacccaaataagataaaactaaagttccaagccttcttctgttatcattacctttctgtttggagaatttcctttagcctttttttttttttttgagttgtagctttgctcttgttgcccaggctggagtggagtgcagtggtgccacctcagctcactgcaacctcgacctcccaggttcaagtgcttctcatgtctcagcctcctgagtagctgggattatataggctcctgccaccatgcccagctaatttttgtatttttagtagcgatggggtttcattatgttggccaggctggtctcgaatgcccgacctcaggtgatccacccgcctcagcctcccaaagtgctgggattacaggtgtgagccaccgtgcctggcccctttagccattctttaagggcaggtttactaacaacaaattctcttagtgttttctcgcctgagaatgtctttgtttcctcttcattcctgacatctatttttgccagatatagaattcacaattcataattcttttcttttacttcttgaaaaatattgagtcacttccttctagttgccatggtttcaaaggagaacttgactgtcatttaaattgatgttccctttcaaataatgttttatggctgggtgcggtggctcacgcctgtaatcccagcactttgggaggccgaggcaggcggatcatgaggtcaggagatcgagaccatcctggctaacatggtgaaaccccgtctctactgaaaatacaaaaaaattagccgggcgtggtggcaggtgcctatagtcccagctcctcgggaggctgaggcaggagaatggcgtgaacccaggaggtggagcttgcagtgagcagagatcatgccactgcactccagcctcggtgacagagtgagactctgtctcaaaaaaaaaaaaaaaaaagttttatttctttctgaatccattcaagatttttcttttttttttgtcagagtttaaggacatgtcttggtatggatttctttagttttatcttatttgggattttctcagcttcttgaatccataggttatctttcttcaaatttgggaagttttcagctattgattcttcaaataatttttcagtaccatattctttcttttctccttctaggaatacaaattaatttttatttatttattttgagacagggtctcactctgttgcccagggtggagcgcagtggcacaatcatagcccactgcagcctcaacctcctgggctcaagtgatctgcctgcctcagcctcctgaattgagttgctagaactacaggcatgtgccaccacactctgctaaatttttttgtgtgtgtgtgctttttgtagagacagggtctcactatgttgctctgctgatcttgaactcctggcctcaaacgttcctcctgcctcagcctcctaaagcactgggatttcagtcatgagccactgtgcctggcctttctcttttttattcttattttttttgagatggagtcttgctctattgcccaggctggagtgcaatggtatgatctcagctcactgcaacctctgcctccggtgttcaagcgattctcctgcctcagcctccctagtagctgggatacaggcatgcaccaccacgtccagctaatttttgggttttaagtagagatggggtttcaacatgttggccaggctggtcttgaactcctgacctcaagtgatctacccgcttggcctcccaaagcactgggatttcaggtgtgagccaccgcacccagcctttctcttttctttttaagcaggtagccttcctgttgagctatagtatgaggggtggttgggatgtatattcactttcccccttggtgctggggccactttcctagaaaatatgaggaacaaacctgacagtgctgcattgcttcctggtagggggtgtacgtttagttccttactgcgctctactgctgctggggagtgagaaatgatgagttgactcgtaccactttgttgatgcagggtgagggcagaaacttagctccccaatgggtcccactgacaccagcaggtgggggagtgaggcaggagtacagactagccttgcacaaagtcagaggacagtccaaaagaccactctcacttctgacaccagctgcgagtttgggggtccccaaaactgtcctcaactttcatgctttgctagagggactcacagaactccctgaaagctgttgtactcacagttacagtttattacagggaaagagttcagattaaaatcaggcaagggaagaagcctggagggcagaatacaggtaagttctgaacacagagatgacagtggagtaatgggcagctttaattgtcctggcaataacatgtgacaaaatgaatggagtatgtcaaccagggaagctcactcaagccttggtgtcactgctagaccttcctgatacttgtttggtaaagaaatcagagtgccacctccttccactgggtgggggatggagaatcagctctcaatttgttcccacccatgctaccccagcaggggaatcagactgttaccacctgcttctgccacatgggagttggaaaatcaactttaatctcctgtcaatgatgtgtgaaaatacacacaaagtattgccaagcagggaagctctcccaagccttggtgtccagagtttttattggggctcagtcatgtagacctggttgactgcccacattgctgacctcattctccagcccctctgaaggtggagctgatgccatgtgacccaaagctcccatcctgaatcacatcacttgactttctgatgtggtctaaagcccccctgtgaacaaacacacttttattaagcaggacattccaaaggctgagagatgacctcccaggagctgaagtttaaattcattactgcatatcctactttgtacatgtcattcacttttttttttttttttttttgagatggagtctcactctgttgcccaagctggagtgcagtggcgtgatcttggcttattgcagcctccgcctcccgggttcaagtgattctcctgcctcagccttctgagtagctggggttactggcgcccaccaccatacccggctaatttttgtagtttcagtagagacagggtttcaccatgttggccaggctggtctcgaactccttacctcaggcaattcacccacctcagcctcccaaagtgctgggattacaggcgtgagcccctgtgcccagcccacatctcattcacttttattgctgccaggtgggtgtggaggttcagcttcacagtgagctttgttgacaccagtgtaggtggaaaatgcaggcctggctggccatgacttgtgccacttgtccaatcttggtgatgctgattgggatggagactccggctctgccgggctctgccaacaccagggtgagaaggaaagaagagtcatggtgagtagcctcaccttgcaccagctcattaagtctgctgaaggggaggggagagagacgggagacccatcaccagaccctgatgacatggctgtggcaggaaaatcagggtaccaccttcttccactgggtgggggatacaggatcagcttcccactcattcccatctatgtaccccagcaggggaatcagagcatcaccacctgcttctgccatgtggaagctacaagaccagatccccagttggccctgctgaaatgacagggaaggggttgcagtttttccatcagtctttggctggcagggcagatatggttaaaaaaaatttctctataatctcagcattttgagagtccaacgtgggaggattgcttgaggctagtagttcaagaccagcctaggcaactgtattagtctgttctcatgctgctatgaagaaatacctgagactgggtaattataaagaaaagaggttcagttgactcacccttccacatgtctggggaggcctcaggaaacttagaattgtgtgtggaaggcacctcttcatagggcggcaggagagagaatgagtgcaagcaggggaaatgccagacacttataaaaccatcagatctcatgagactcactcattatcacgagaacagcatgggggaaaccacctccatgattcagttacctccacctggtcccgcccttgacacgtggggattatgggaattacaattcaaggtgagatttgggtggggacacagagccaaaccatatcagcaacatagtgagacctcctgctctacaaaaaatacaataattagccagttgtgttgatgcacacctgtagtcccagctgctcaggaggttgaggcaagaggattacttgagcctgggaggttgaggctgcagtgagccatgatcgtgtcactccactccagcctaggcaacaaagtgagatcatggcttaaaaacaaaaatgaataaaaaatcctgttgctggttttctttcttttcttttgattcaggggaactggcttttcttagagcgtttttttttttctgtgcttggtagtggttccaggtcagaggcttttcctttactgtgtctgggatgttggggtatatggaagacaataagaaaactcaggctgctcactgccacgagtgcccaaagtcccaggatccagaggtagtatgtcttctccttttcacctttcagaatctccttatgcttgtctgctgtgttatgtctgtgagttatcagttgtaagagagaggacctgggaagaatgacactactgcatcttggccagaaccagaagtcctgtagcttgactttcactttgcttatgatactgtatttagttttgacttttaatgagtcaaatgcattgaccttttcctctaaggtttgtgtgtgtgtgtctgtgtgtgtgtctgtttaagaaatccttctcgacattcaagtcataaagatagctcagactttttctctagtttttaattttttttagatggagtctcactctgttgcccaggctggagtgcagtggcacaatctcggctcactgcagcctctgcctctcccgggttcaagcgattctcctgcctcagcctcccaagtagctgggatttacaggcacacaccaccatgcccagctaatttttgtatttttagtagagacagggtttcaccatgttggccaagctggtctcgaactcctgacctcaagtgatcctcccacctcagcctcccaaagtgttgggattacagatgtgagccaccacgcctggcctttttctctagttttaaagtgctttccccactcccatatttaggtatttagtctaattggaatttatttttgggtgtgacagtgattttcaaagcatgatccaaggaccctgggtgactgagactctgtcaggaggacgatgaggtcaaactattttcctaatgatgccaagatgtaatttttctttattgtgttgacattcccaatgacagtgccaaagcattggtgggtaacactttttgcaccttagcacaagaaggcagggcaccccactctactcatcttcatattcttcatggccatgtattcacagttaaacaaacatgcaccagtttcatttaagaatgttcttgatgaagcagtgagagttattattgttactgactcctgatcccaagtatgtctttgagctcttctggatgatggaatgggaaatacacgaaaagcacttcttctggattctgaagcacaatggttgtctcaaggaaaagcacttatgcagtggctggaactgaactagctgccttttgtcttttgttttttgtttgcgtagaacatcattgaaagaaatactgagaaactctgatttttcagccttgggtatttgtcagacattctctcaaaaatgagtaaataagcctgtcacttcaaggaaaacaactgacagtgtttgttgctggtgatcaaacttgagctttcaaataaacaattagaattctggaacacttgtatctgttaccatgggcttgatggtttccaatagaagactttttgatgtgattggtcgtaatgttaatgaatgtgattttggggatgaaatgtgtcaaatgtggaagatcagtgtaaatcagtggcctaatgttttgtaaatgaccaatacatgatattccaaaatcatacttgagcaaaagatctttcaaagagtaagatagaccaatgaattctcatgtaacagagtatgaattgatacagtttcagattccacattgcaagtaaaccttaaaaatgactacttcttgagtttgggtgtcatagaaaataagaatattcacaataatctgaaaaggctattaaactactcctgcctttgctaaccacacatttctgtgaggttagattttccttatatactccaaccaaaacaatatatattaaaacagaccgaacatagaagcagatataagaatctagccagacattgaaacgatttgcaaaaatttaaaacaatgtcactaaaaattttttgttttgaaaaatagaagattttaaaattaaataacatgttacctatgttaccatgtaatgaatttatagtgaatttaaaaaataaattattaaggccaggtgtggtggctgacacttgtaatcccagcattttgggaggctgaggtgggaggatcacttggacctgggagattgagaatgaagtgagccattatcatgccacgccactgcactcgagcttgagcaacagaatgagagcctgtctcaaaaatttttttctaaaatttctcagtttcaatttatcatatagttttcatatatatatataatatatatataatatatatttaaaaagctctttgggtcctccatatttttttaaatggccaggaaatgttgatctatggcatgaaatagagatctgattttattaatttttttttttggagatggagtctcactcagtcacccaggctggagtgcagtgacacgatctcggctcactgcaagctccacctcctgggttcatgccattctcctgcctcagcctcccaagtagctggactacaggcacccgccactatgcccggctaatttgttttgtattttttagtagagacggggattcaccgtgttagccaggatggtctcaatctcctgacctcgtgatccgcccgtctaggcctcccaaagtgctgggattacaggcgtgagccactgcacctggccaatctgattttattttcattttctcatgtgaataaccagtttctccagtagctgaagtagtctatcctatccctactaatttgtaatataacctcttgccattagtatgtttccatattcatttgattgtgtgcctagactctttttctattatatatatttatttgttcatccatatgccaattccactgtctttttttttttttttttttttttttgagacagagtctcactctgtcaccccggctggagtgcagtggcacgatctcggctcactgtaacctccgtctcccaggttcaagtgattcttcagcctcagcctcccaagtagctgggactacaggcatgcaccaccacaccgagctaatttttctatttttggtagagatgggttttcaccatgttggccaggatggtttcgatctcttgacgtcaagatccactgacatcggcctcccaaagtgctgggattacaagcatgagccactgtgcccggccaggaattacacttttagaaatttgtattatacagatatttgcaggaatgcatgaagatctgtataagagaatttcattagagcattgtgtctaataataaaaaattagaatcagtctaagagtccatccatagagaagtggctaaactatggtagaactttagagcaaaatattatgtagctatttggaaaagaatgcagaagatctaattgtatcatcatggaatggtcttcaagatattaagtagaaagtcaccaagtggaaaaacaagtcacagaatatgtagagcatgttcccatttctgctaaaaaaaaaataataatacaaaaactcagccgggcacagtggctcatgcctgtaatcccagcactttgggaggccgaggcgggtggatcacgaggtcaggggatcgagaccatcctggctaacacggtgaaaccccgtctctgctaaaaatacaaaaaaattagctgggtgtggtggtgggcacctgtagtcccagctactccggaggctgaggcaggagaatggcgtgaacccgggaggcggagcttgcagtgagccgagattgtgccactgcatgccaacctgggcgacagagtaagactccatctcaaaaaaaaaacccacccaggtgcatgcccaactactaccagcgatttgtcacctctgagaagaggagtgggattggaagagagatgtcaagggaactcttttctttcctttttaaaacctacttctagattgtctgcattttctataacaagaattaattaacatattgcttgtgtacttattttctttttcttttctttcttttttttttttgagatggagtctctctctgtccctcaggctggagtgcaataatagcatgatctcgggtcactgcaacctccacctcccaggttcaagcaactctcctacctcagcctcccaagtagctgggattacaggtgcctgccaccatgcccggcaaatttttgtatttttttttttagtagagacggggtttcactacgttgactagcctggtcttgaactcctgacctcaagtgatctgcccacctcagcctcccaaagtgctgggattacaggcatgagccaccgcgcctggcctgctgtgtaattctaaataatcatcaggaccatgaacctgaccatctgtgaaagacagagatgtttcctggcaggatagggtccactgccattgatattggcaaggtgcctgctgctccttagcctgctgtaggtaccagattgaccttgagtagaaccagccttgagagaagaggaaaggagagccaggccctaatcatagggatccccaggggtgtagatgatgttaaggcaacatcttctctgtgtctaagagaaaaagaatctgccctgagtatgaactgacttgtgtgctttgaggtcagtgtcctaaacaggaagccatgaggtgagcagagacacttccctgctgcctggggctgggagttgggaagtgagaaaacatcctagtggccaccagaaccatccagtgggtggctctgaatcctgcattgatttgttgggagactttggaggaggagcctggtgtggagggttgagcctggtgagttggaggcagcagctggttactttccatgcagagcagcttggagttgagtcactcgacaatccaagggcacctgtggaagcagccatgactcatgctaccttcagtttcacatctggaggaggaaatcactgacaaagcaaagcaaggcgacttctgggggctgccgtgtaggattctcccatgtttaaaaaagaaaaaaagattgtacaggatttaaacatagcatttattgcctgtgttcttagttataaaattaatacatgtacataataattgttgtagttagttattttattcagcatttatcctatgtcaggtactgatgcttcaagctttacatgcgttgtctcacttagtgtttctgaccattcagtgggggagatctgttattatacccattttacagatatggaaactgagtctatacacacacacacgcgcgtaaaacacatagaaaaaaatcacccacaattctacccgccaaagtcaaccaacatcctgatgcgtgtttttctagtaaccttttaatatttttcctgtgtagctaatatccaactattttactttcccatatcctgcctttttcactcagctctaaattatgatcctagtcccaaatcatcacatattcttcaataacttaactagtccatatggccaaacattgtatgtttccaatttttccactgttataaaggttgctgttgtgagttatcttagtgggctaaactccgattattcctctaggaagaacatggaatgatacattcttctaaagaaatgttctgtgtttctatgctcttccctctactaggaggcacttgaacggagtggttgagagttgtaaaaacctatttttatttatttatttatttttgagacagagtttctctctgaagcccaggctggagtgcaatggcatgatctcagctcactgcaacctctgcctcctgggttcaagtgattctcctgcctcagcctctcaagtagctggggttatagatgtccaccaccatacctggccaatttttgtagttttattagagatgaggtttccccatgttggccaggctggtctcgaactcttgacctcaggtgatccactcgcctcggcctcccaaagtgctaggattacaggcatgagccaccgtgcctggccagaaaaatctatgtttgagtcccagctctctgctgatctacaactatgtaaacttgggcaagttatgtcccctttctggcccttgcatacttacctataaaacaaggctaaagtaatatttactacctcaagggttgctgtgaggattaacgatgtaattactgtaggtagaggtatcttagtccatttcatgttgctgtaaaggaataccggaggttgggtaatttataaataaaagaggtttatttggctcatagttctgcaggttatacaagaaacatggtgccagcatctgattctggtgaggggcccaagaatcttacaatcactgtggaaggtgaaggggaacagacatcacatgtcaagagagaggaagagaaaagaggaagatgccagcttctttaacagccagatctcttgggaattaagggtgagaactcactcaatcctgcaaacatggcatgaagccattcacgagggatctgctcccatcatccaaacacctctcaacaggccccacttccaacactggggatcaaattttaacatgagatttggagggaacagatgttcagaccacatcaaaagggcttagcaccttgttattaggcctagaaagcatctcccccttctcctgcctcttgaccaccatatctagcttcagtgacactccttttgtgaaatctctgatatctgcgtggttaaaattatgctcttcccccaacctcttttttttttttgagaaagagtctcgctctgctgcccaggcaggagtgcagtggtgcaatctcaactcactgcaaacttcgcctcctgggttcaagcgattctcctgccttagcctcccaaatagctgggactacaggcacacaccgccacacccggctaatttttgtatttttagtagagacagggtttcaccatattggccaggctggtctcgagctcctgacctcaggtaatctgcccaccttggcctcccaaagtgctgagattacaggcgtgagccaccgcacctggcctctttccccttttttaaaaaaagaaggcgaaattcacataacatagcattcatcattttaaagtgtacccttcagtggctttatgtacattcacagtcttgtgcaaccatcacctctagatgccaaacattttcatcatcccacaaggaaaccacttacccattgaccccttatccacagtagtcactgtacttcaaggtttcccatatcccatatccagcgtggctggatccaagggatcaaatgccatcagtaggactcagtttttctgcatctacttgtgttggcttcactctcgggcagatgctttccatatggcaatcccagtggctctaagcttacattagccatcaggtagcaatcccaacagagagagatcgtttcattagaagtttcaatggaagtcatgggactgagtattattgcctcaacttggataatttgcccatggctgaactgattaccatggtgggggagaggggaagaggtggcggtagaatattctgattggccaggttctgggtcgtatgttcattcctccaaattgcattcagaaaatgggtgctggatggggcaaaaaatcaggtgtcattcaaagttcactaggcttagggagctgggctcagaggccagaggcctgatcttgatcttgtcatcacttagcaaatctcctggccattcaggccttcacacttcctgtctgtaaatgggtttatcaccactcattcaagtcctaattattaccagcgctgagaaaccaatactttctttttccatctcgcttgtgtaatttcttcggagaagcatttggatggtctctgaaccatttttaccctgagaaatgggacttaggaaattatgcagccacattttatatccattctggtcatttcagtaattggttctgagacactatttccccgagcaccatcccaagtataaactactatttccatctgtgttactggaggaaactggggaaagacatttgtgggttttttcccccccaggccaaaaaaaaaaagcaaacaaacaacaacaagaaaaactaaagtagagcccaaaaccaatttgttggttcccagcttggcttaggcaccattctaagcatattccactagtccctccatctccaaactagtcattcttgggagctgacctacttagtgcacagcaaaggaaataaacagaaatccagcaagtccatcatttgagaggcccatgctgatgactcagagaatatataaaatggcaggttggccaggtgtagtggctcatgcctgtaatcctagcactttgggagactgaggtgggtggatcacctgaggtcaggagttcaagaccaggctggccaacatggtgaaaccttgtctctactaaaaatacaaaaattagccaggtgtggtggcacaatcgctggaacttgggaggcagagactgcagtgagccgagatcgtgccactatactccagcctgggcaacagagcaagactccatctcaaaaaaaaaaaaaaaaagccaggttgttttgctcttaatcgggttacgtttgaggattcttttggttctaggtgaccaaaacccactgggttcagccaaaagtggatattgttgaaggattctagggtgtctcacagaacacagggccatggttccactggaattcaggaaggggatagagtccattgtgaatcaaggaggtccctcccaccacctctacctcttgactgtttttctccatgtctcctctattcttctatctcatgggagagtgacagaagtcaggttgagactggaatcttaatctcagcaccaaaagctcagggaaggagcctattggtccagcttgggccagatgttgacacctgatccaatcaaatatggagaggggatgtgagttccattgtatcaacatgatcgtgttagtggtccagaaatacttctgagggaaaaaaaggtgtatgttacacagtgatatcaattaaattctaaactatagtgaaatattattgtcatttccacctcttttaaataaatctgagatggtctaacccctagcatagttcagtttctgggtctagattactggggtttgaatcctggccccaatatttgctgtgtgatcttaggcaaattacttaacctgtctctgtgccttcgttttgtcatctacaaaatgggtataataatattacttacctgacagcatggttggagccattaaatgtgttaatgtaagtaaaatgctcagaactctgcctggcaaatagtaaagatttaacaaatagctattattattactgtaaagttcatttcattatgacagattgtttttcagattattcaaaatatagaagatgtttaaaagggaatttctatgataatgggaaaatagggctgaataaccattactaagattgaatatatcattgctattgcccttgaattctataatttgaattcatattatttgaattctagacggtacttttgatttataaccttaaaagctttagtaagggtttcttctaaacagccttatataaaataatagcaattcttgccatcttacctagcaggaaaaaccaattgttttatcaagtttgccagcataagattgaaatttaaagcctttaatatcttagtttataaaagacaagttacagaatgtctctttcctggatgtcttagaattacagtatcttttagggcaggagtctgtgaacctttgcttaaaggactcatggtaaatatttttgtctttgagggccatattgttaaaggaaaggggtcccgatccagaccccaagagaggattcttagatattgtgcaagaaagaactcaaggcgaatccatagagtaaaatgaaagcaagtttatttattaagtttcttaagttattaagaaagtaaagaaataaaagaatggctactccacagccagaacagcagcttggactgctcaactcataatgcttaacagttttttctaaattatatgctaaacaaggggcgaattattcatgagttttctgggaaagaggtgggcaattcccacagctgagggttcctccacttttaagactatataaggtaactgacattgccatggcatttgtaaacagtcctggcgctggtgggcgggtcttttagcatggtaatgcattataattagtgtggaatgagtagtgaggatgaccagagatcatgtgcgttgccctcttggttttggtggcttttggccagcttctttaccgcaacctgttttatcggtcaggtctttgtgacctgtatcttgtgccgtcctcctagctcatcctgtgacttagaatgcctaacctcctgggaatgcagcccaataggtctccgcctcattttacccagcccctattcaagatggtgttgttctggttcaaacgcttctgacagtatggtctctgtcccagctactcagccctgctgtaacacaaaagcagtcatcaacagtacctaaacaaatgggcatggatgtgttctaataaagctttatttatagatgctgaaatctgaattttttgcagttttcatttgattccacgctgaccccttgccccccgtccaaatattcacaaatgtaaaagccattcttgtctcacaggctgcacaaaaagaagtgatgggctggagatggccttggggccatatttttcataccctgctttaggagacagtgcattagcattctgacagcaggcaggggaggtacaagatgactgtctactgcctcttgggttctaacaccccagatgcatgttgaccccctgctgcttctcatcatgcgtttctcttaaaagatacatagtatttgtggggctgggcgcggtggcccacatctgtaatcccagcactttgggaggccgaggcgggtggatcacgaggtcaggagagcaagaccgtcctggctaacacagtgaaaccccatctctactaaaaaaaaaaaaaaaatacaaaaattagctgggcgtggtggtgggtgtctgtggtcccaggtaccccggaggctgaggcaggagaatggcgtgaaccgagatcgcgccactgcactccagcctgggcaacagagcgagactccgtctcaaaaaaaaaaaaaacaaagatatatagtatttgtgtgactttcttggttttgtgcaacagaaaactcaacccaaactgcatatgcaaaaaaaaaaaaaaaaaaaaaggaatgtactaaccggggtttctacactctaggggtggttgaggcaggagtccaaagtctatctgtttatccctcagcttttatcccctccatgagggctttgttcttaggattcagggtttcttttcccccaggggggttcacagcaaagttctgggtctgactacttctggtgtgtatctgatcctatatctatctgaatctgaacgggaagggaacacagtgagcaccttaggccacacctgggtagggtaagccccattaaatttgcaagtcctgggagcggtggtgccagttggttccccaaaggaaacaggtcctattacctaagaaaggtgaatggatactgggaggcaaatcaacaaatgtccattgcacatgaggacatcacactgtgacatttagaatctaaatgctctgaacaaaatgtataggggaccttccaggaacgggaaattgctgttcctaccccctctttttggagaaattgctgttcctcccattggcaaaattcccctcgcaggttccagcttctttctcttagaacagaccttctggtttggcaagcccagtcccacatcgaggtttagttctggacttctgtgcagggtcatggcactcgcttgattgaaattttgtttggggaagcaatgacctgaagagcttacagcctgggtcaaccactcaccactctcaggaaaagcagacagagccaaactttctagctgggctcaaaatagctattttctgacgtgggtcctccatgactcatggtggagttttccaggctcgaggggactgttgacatttactctgctcctcccacgccacagagtctaactttttctatcttcccccaaacataactcattacctccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtagagacggagtttcaccgtatgagccaggatcctctcgatctcctgaccacatgatctgcccacctcggcctccccaagtgctgggattacaggtgtaagccacctgcacccagccctccagatccaatatctttttcctccatcctttgccaaaccaggacttcagcttctggttactggtgcccacttcaagagatgccaggcagggaactctcaggacacataccaggcctgcactggcatatgtattttttggagacaggatctctgtcactcaaaatagagtgcagtggcgtgatcatggcccactgcagcctttaactcctaggctcaagtgatcctcctgcctcaaccttctgagtagctgggaccactggcatatgccaccacacctagctaatttttcaaaattttgtagagatggggtcttgctatgttgcccaggctgatcttcaactcttggtctcaagcaaccctcctgcctcaacctcccatagttttgggattacaggcatgagccactgcacccagcctcggactgctactttagaccccactttcttgtccaggtgtgatcctgggtgcgtgtgcccagagacgccctggctacctgggattcatccatcaaacacctggtcattcagccaattctgtgcgaacagcaccttcccggctgtcccaccctctgcaaagatctgtgatgctggaaagttgtgtgtggctaagtcggaagaagtgaagttcatctgcataagtgcagtagtgtatttattgatttttattcttattttttatttttatttatttatttgagacagggtcttgctctgtcacccaggctgtggtgcagtggcatgatctcagctcactgtaacctccaccgccttctgggcttgagcaatcctcccacctcagcctcccgagtagctgggaccagaggcacacccaccatgcccggctattttggtttttgtattttttgtagagatgaggtcttgatatattgcccaggctggtctcgaactcctgagctcaagtaatcttcccgcctcggcctcccaaagtgttgggattacaggcgtgagccaccacgcccagtccagtagtgcatttactgatagcacttactgcagctattttcttttattgcatttactgcattcctgctatgtcccaggctttgcacacattagtaggcgttcgatcctttaacaattctttgaggcagtagcaggtcttcctatttctatacttgctcccttagtagatcacactctcatgggaaacacagtgacttttttttttctttctttctttttttcagacagagtttccctcttgttgcccagtctggagtgcaatggtgagatcttggctcactgcctcagcctcccaagtagctgggattacctgccaccacgcccagcctgattgtattttttaaaattaaaattgaaataccatcaataggttgaccactaggactaaaatccaaacttttcagtgtggcctataggccgggcatcatggggccacttcctgtctctccatcttggaacaccccttcccttcctcattttgctccacccacatctgccttttctctttcttttagagacaggatctcactgtgttgtcacctctcacagcttctgcactcgtggatcctctatctgaagcattcttccccctccgtcttcccaggccagcttctgctggtcattcagtgtcagctcaaatgccactttctcatagaggtcttctgtgaccccgctatctggaggagtccccgggatcaatcactgtctacccccgtaatggcattttactctcttcctagccctgtccacctaaatgatgttgtttgtttatcttttggcttgctgtctgtcttcatcaggaggatggatgtttcatttctgcatgcctagctcctagaatattgcctggtgtgtggcgggcatgttgaataaacaaagagcccccaaatgacataggaggccatgccatgtgccccagtccctgcagaggagcgaccatccaccagcagaccctgtgtctttgaaaggaattccagagagagtaaaaatcagtgcctatgaaaagtatcccaactggctgcaccattgcctagcttttgtgctcagtgtttttggttttgttttttcgacatcattggcttttaaagccaggtcaacctttggacttgaaccctcaggttttgcatctcccgctgcactgctgggcagtcgacccttcccaaaccaccagttctagctgagacacacacgaggttctggatttttgctccaccagcaggtgatcctcttcatcttccattgcaggcatctttttctttaattataaaaataacaccatactccactctcaaggaagcactcataactccctaccctataagtgtgggctgtgtatagtgacttccttccaaagaggaagtgaaaggagaaactttacaatggagaaacctggcagacactccctcagccaggggctcaaggtcagcatcaacagtgccaactcatcttgatgggatgtaccacggatgtgaagtgatgagaatggtggccgggcaccatggctcacacctgtattcccagcactttgggaggctgaggcgggtggattacctgaggtcaggggtttgagaccagcttcaccaacatggcgaaaccttgtctctactaaaaatacaaaaactagccaggcatggtggcacacacctgtagtcccagctactcgggaggctaaggcaggagaatcgcttgaacccaggaggcggaggttgcagtgagctgagatcatgccactgcactccagcctgagtgacaatatgagattccatctcaaaaaaaaagaaaaaaaagaagaaagtgatgagaatggtgacttacctctgcagtcttctctccaaactcacaacttgtctcaccatcagaaaaactcaaaattaaagggtattccactacaaaatacctgtgcagtaccccttaaaactgtcaagggcaggctgggctcatgcctgtaatcccagcactttgggaggctgaggtgggcagatcacctgagttcaggagttcaagaccagcctgaccaacatggagaaaccccgtctccactaaaaatacaaaattagccaggcgtggtggtgcatgcctgtactgccccctactcgggaggctgaggcaggagaatcgcttgaacccaggaggcggaggttgcagtgagctgagatcatgctactgcacctgagaaactgtcacagtgtagaagagtctaagaagacacaaggactgaatgtcatgcactgtcctcgatgggatcctggaatggaaaaagaacattggcggaaaaacaaggaaatctgaacagagtatgcattttaatctttttttaaatcccctaaggatttccagtactgatgctttgcctttgtgcttgagatccctgtttagagccacatctcccttctggtgtggattttcagtccgacatgaatgcttccagatttgcttccttccttcttctgccatgatctgactctccctctgacttcacattgaactggacccgttcacgcctgcacacatcctgtttttcccctggctgctcttccctgcgtcccccctccgcagaccaccctcattcagatgaggatatatcccaccctatttcttgggcttacctttctgaatgaaaataatgttcctggtgcaatttatctctcctgtcaaatttccagcctgcagggaattaaatgaggcacatgattttcaggctaagcagtttttaaaaactgaaatattactttagacaggcccaatttattttcctctggattctcatcattttaaccccgccaagcacatggttttaagcagctccatctgctcctctaaccatccttgcgtgacctgggcccttgactgacttctgaattggtttgtaaattggaagaattagggagtcggttaagatgcatgaatcatagctcaggatagatttataattgtctgttttcatgaactcattctgagattgcagggatgggggatatttcagaacaaatggaccttgagtaacagaatgaacctacagaagtgccgaaaaagatttgttgtttatgcaattttaaccgggcaattgttgttattataggtttatcaatttccacaattttaattccacagccctaatgatttgctttgaattaggaagtatatactttattctctcatatggtcccaaagggccttagaaagcaatcggagcccttctgcttgtcattggaagaaatatgacagcatggtttggtgattcattgaaggtcactttgaagtgttggggagaggacactgagtaatgtaaaatgacattacaatttgttaaataatttgccggaactcttgtgtcatctctttcaaagtctcaccctggaaataacacacacgtaattcaaatgcaatctttctggaagtcccacctgggaactgcagtcccaatctgtggcaaagtcttgtgaatatccttaatgtgataaaactttgccttagacggagtttgctttttggaataaccaaagtcattctgggccaaggtgtttgaataaagtggttgatcaaatgaaatttaatgtaaagttattttaactgcttttcttgagtaacgcataaactgatttgaaagcaacaaagaatttgtttattactacctctccttattccagaaaggacttaatgatcttattggagccttaaaaaagttttaaaaggctcaagaaatgttggtaaatttccttttttttatcttttttttttttttttttttttttgagaaggagtcttgctctgttgcccaggctggagtgcagtggctcgatctcagctcactgcaatctctgcctcccgggtttaagtgattcttgtgcctcagcctccagagtagctgggattacaggcatgcgccaccacccctggctaatttttgtatttttagtaaaggtggggtttcaccacgttggccaagctggtctcgaactcctgacctcaagtgatccgcctacctcggccttccaaagtgctgggattacaggtgtgagccatcacgcccggcctaatttacttttattattattattattattgttgttgtttgagacggagtttcgctctgttgcctgttgccaggctggagtgcagtggcgtgatctccacctcctgggttcaagcgattctcctgcctcagcctcccaagtagctgggactgtaggcgtgcaccaccatgcccagctaagttttttgttttttgttttttgagacagagtctcgctctgtcacccaggctggagtgcagtggcatgatcttggctcactacaagctccgcctcccgggttcacaccattctcctgcctcagcctcccaagtagctgggactacaggcatctgccaccacgcctggctaattttttgtattttttagtagaggtggggtttcaccatgttagccaggatggtttcaatctcctgacctcgtgatctgcccacctcggcctcccgaagtgctgggattacaggcgtgagccaccgcgcctggcctacttttattatcttaatatcactcttctcatttctcttctctaagcctaatattagtatttgtggacattgcaggtgggacacaagacctttggtgcttctcatcttccaagagggcacagaatgggatggtgtatgaggtgggatattcccagccaagggagttctgggagggaggtgaagttggggcaaagaattcccatgggctaatgtcctctgtgcttccccaaccctagttccagctgatgtggaattctgagtttggctgctttttcttttgttgatggtggtgatggtggtggtggcaatgatgatgatagtgatgttgatggtggtggtggtggtgatagtggtgatggtgatgatgaaaggggtggtaatgatggtggtgatggtgatgatgacagtgatcgtgatgatggtgatggtgatggtggggatagtaatgatggtgataatggtgatagtgataatggtgacgatgacagtgatgtgctagtgatggtgataatgacagtgatggtggtgatagtgatagtggtgatggtgatggtaaagataatggtgatagtggtgatgattatgatagtgatagtgattatggtgaggatagagacagtgattgtgataactgacattcaccaagtcctcactgtccttatgatgtaccaggcaccacattaagagccttatatacgatctgtcattcaatcctcactgcatccaagggtaccctctattattatccccagttaacaggtaatgaagactgaggattgggaaagttacataactcacttaccagccacacaactagctattatgaaatgaacaaatattacaagctaaggattaatagacccactttacaagggaaatttttttttttttttgagacagtcttgctctgtcacccagcctggagtgcagtggtgcgatcttggctcactacaagctccgcctcccgggttcacgccattctcctgcctcagcctcccgagtagctgggactacaggcgcccgccaccacgcccggctaattttttttatttttagtagagacggggtttcaccatgttagccaggatggtcttgatctcctgacctcgtgatctgcccgcctcggcctcccaaagtgctgggattacaggcatgagccactgtgccaggcccacaagggaaattttttaaagtggaaactcagagaatttaaataacttgtccaggggcacaaagccaggcaggggcagagccaggcaggggcagagccagcctttcaccattcaccattgctggctttgaacatgaagcaaggggccataagccaaggaatgtaggtggccaaggaatgtagaagctagaaaaggcaaggaaactcattcttccttagagccccaagaaggacaggcaatcctgctgacactgttaccaaaacaccaggggattcgtctaggtcctgctgctcactgcacagaaggccgacactgagacaacaattattgctaaggaaggaggctttactcaggtgttgcagccaaggagccagtaactcagtctcacatccatctccctgaccaactaaaatcaagggtttatacagcagggaagagatgtaacaatgtgtaacaaaacaggaacttgggacgggcaaggaagcaatcccgatgaatgaggggtctggcatctcattgtctggatgctgtaatctggtgagtttcagttctttgatacttatttgagaggcaaggaattccctcctgaggaaggaactcagataaaacaaactttaagtttcaagagttaagaccagaaaggtcaatttctatgtttatcaagaaagaaaaaaactgtctatgggactacttgtgttggtttcaacaccctgattttcacgtccgttgggcctctgtcctccagaactataataaatgtgtgttgttttaagccactaagtttgtgtttatttgtaactgagacacagattggcatttttttccactgtcacccctcttgccttgtatcatcagttgttagtatttgttttagctggggaggcagctggagcatgaagtcaacaggaacaatgatgatctgcagggaggaaagccctaggatggcgggataatccccattgtgccccctcatcattagccacagtacttggctggcatttgagcagagtggttatcacagcagcgttcactctcctgcccccgggttcctgttcttccctctcttcaagagcactcaatgcatatctctccaaaccagtgcttctccacctttaatgtgagtgataatagctaacattcagcacactgtgctcaatgtgtgaatcccctcacttaacctccataccaacccttgagatagatgttatcattatccttcccatttcaggaaactgaggcatagagtgtttaatgaagaatcacctgcttgaagggcagcttgctgggtctcctccagggagattttgattcagtaggtccaggagaagcccaggtagatggattttttttttttaatcacacctaggtaagtctcatacctgtgccctgggagcacaataaaaaaactctgggtttaggctgtgtgcagtggctcatgcttgtaatcccatcagcttgggggtctgagatgggaggatcgcttgaggccggtttaagatcagcctgggtgacatggtgagactccgtctctacaaaattaaaaggacgtgatggtgcacacctgtagtcccacctattcaggaggctgaagtgggaggattgcttgagcccagaagcttgaggatgcagtgaggtatgatcacaccactgaactccagacttggtaatagagtgagaccttgtttcagataaaaagaggaaaggaaagaaaggaaaaaagaaaggaaaggggcaaaaggaaatgggaagggaagggaagggagaaaggaaggaaggaaaaaagaaagagaaaggaagaaagaggaaggaaggaagggaagatggaactaaggaaggaagaaaggaggaaagaaagaaaaaggaaggaaaagagagaaaggaaagaaggagaaagactctgagtctaaacccgtggttttcaacaaagggtgattttgtcccccaggggatacttgccagtgtctgaggacattttgggttggggagaggatgctactggcagccagtgggcagaggccagggatgctgctgcacagcctacagtgtttagcacagcccccagcacaaagaagcgtccaactccaaatgtcaaagcactcacaggctatggagcagcagtgagatgaagctcttgctctagccttggctcctgcactcagaatgagtcttcagatgttctcagattacacttccagaggattaggctggaatttgtctttcttgtgaaagaaactctttgtctcaagtgttgggtcctcccaggattcctccccaaatgggctatcttagtttctcctctactcctcaatctcacctcttcaccttcatccttatttcctatttcactgcaaaagtcaagggcccagcctggccaacatggtgaaactctgtctctaccaaaaatacaaaagttagtcaggcgaagtggcaggcacctgtaatcccagctacttgggaggctgaggcaggagaatcacttgaacccgggaggtggaggttgcagtgagccgagatcacaccactgcactccagcctgggagacagaatgagactccatctaaaaaaataaaaataaaaaacaaaaaaaaaaagtcaacggcatcaaatgctctcctctgctccctttgtcatttctttgtacttggacctcttagatcttggacttctatgaggtcacagaggaagagcatgtttccagaaagaaattcctacaatcagccagttctgcataatcttgtggttcacgagaggggaaggaccacagcttctccttgagtccacctgggaagggcatctgtggacaccttctctctgcctccctttccttcctcccagttccttcctagagggatggtgtttgatttctgaggccctggacatttcttccagctcatcattcaggttgttcagagcatttggaagacgagcttttctcttgccaacactgaccgcctcttgcgggaagatgtcgcagcattattatttaataacccgtgtctttcttcagctcatcaaagaccttccagctccagataaggagtcggggtagggagtaaggaaacaaagggatgagggtacaggaaaatcccagctgccccttatcacacaatcaatatattcaatcaatatagttaatagcaatgtgccaatgtcagtttcttggtaaagttaacaaatagtggaaattgagtgaggggggtagaggggaattctgttggctctttgcaacttatcactgcccatctccagttttctggtgcctttgctcagatgctgctgtggagtcccctccacagagatacctgtgtccttctccccaccttcctggctcccaacagactacactgcctgagagagctgaagtcaggcattcattctgcaggggattctgggtcacagctgagccagtcctattaggatttagggggcagccgacctgtggggcctgcaccgcacacactccttctaagggtttcctcacagtccctgctgaaggggagggtctcgtgtgacctgtggctccacccaggttgaacgtgctgaggccctgaccaaaggcagggccacccataggctgccaggggctggaggtgggacgagagggtccatcagaagtcctttcatgagagcagttaagagggaagcagaagagtcctgaaatggagaaacacctcagggagacagaatctttgaggaaggggaaggtatcagggagaaaagaaagaaggagatgaatggagggtcccaggatggtgaacaatgacttgggacttgggagcacttgaaatgtggccattccaaattgagatctgttcttcctttatttagttttgagacggagtctcactctgtcacccaaactgtagtgcagtggcgcagtctcggctcactgcaacctccatcccccaggttcacgtgatccttgtgcctcagcctcccaagtagctgggatgacaggcacgtgccaccagacgtggctattttctgtatttttagtagagatggggtttcaccatgttgtccaggctggtgtcgatctcctgacctcaagtgatccacctgcctcggcctcccaaagtgctgggattacaggcgtgagccaccgtgcctggcctgaattgagatctatttaaagggtaaaatatacatactggacttaagacttccatactccctccaaaaaggatataaaacatctcattcgtatctttaatatattgattacattttgaactgataatcctttagatctattggattaaataaaatatgttagtgaaattaatctcgcccatttctttttatctttttttttatttttaagagacagggtctcgttgctatgttgcctaggttggacttaaactcctgggctcaagtgatccccctgcctcagcctccagagtagctgagactacaggcatgtgcctccgcacccagctctttttacttttttttttttttttttttttttgagatggagtccgttctgtcacccaggctggagtgcagtgactcgatcttggctcactgcaacctccgcctcccaggttcaagcgattctcctgcctcaaccttctgagtagctacgattatagtcacctgccaccatgcccagttaattttttttgtttgttgttcttgttgttcttgttgagacagagtctccctctgttgcccaggctggagtgcagtggcacgatctcggctcactgcaacctccgcctccccagttcaagcaattctcctgcctcagcgtcctgaatagctgggattacaggcacacaccaccacacctggctaatttttgtatttttaggaagacgggctttcgccatgttggccaggctggtcttgaactcctgacctcaggtgatccaccgcctcggactcccaaaatgctaggattacaggcgtgagtgagccaccgtgctctgccacggctaatttttatatttttagtagagatggggtttcaccatgttggccaggctggtcttgagctcctgaccttaagtgatatgcccaccacccttggcctctcaaagtgctgggattacaggcatgtgcctccacacccagccttttttattttttagaatgtggttcctggaatgttcaaaattacatatgtggctagtgttctatttcaattggaccgcactgatctatacattctctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaattacttttgtgtcctttgacacgtcagatgtggctggggaaacagaaactcgcagaagttaaaaaaatgtgcttgaggtgccactggagaataacaatcatagccaggatgtgaagcctgtcagtttcctcagccgcaaattcttccatgtggggcgacctcacagagacgggatgtatgggacggcggagtgcaaagaaaggtatgatcgctcttgggggcccagtggcatcctctccacgaggcaggctgggagaaatcgagcagccaggagcttctgggttaaaagcagtgacttcatctctttgggaaacggtgactcattaaaagcaacgggcggcttcccattacattcacgttatagcaagaaggcgaggcacttggtgcatcccgtaataggatgcttgggggttggaatgagcttctttcctacatgaatgattgatgacaacgaagtctagagtgccaccaggagcctttgaaatgcattcagatattggctccctggtcatggggcgcagatctattcccttgggattcaagactctcttttgggtcaatagcagcaactggcttcttgacaaaaggctggagggggccccctctagattctcttctcagggcaggcatgggtctgttggagctgcggggctgtggtctcacctagaggggccaagagatggtccccatgaccatgagtctgtgttcttcaaatttgatggtggctccaattttattttctccccagtgttagtctggcttctttcagggaaaggcactgtgatggcaggaataatgctactgaccactctttgtgatgtctaggcactacaccaagcacatgttgtatacagttggtcctctgtatctgtgggttccgcatccttagattcaaccaattatggatggaaaatattcaggaaaaaaatccacaaattaccaagaagcaaaactttgagtattatgctgaatctgtgtaaatgaagtgatgtgtaggcatcctattagggattataagtaatctagagatgacttaaagtctacaggaggatgtgtggggcttctatgcaaatatttcaccctgttatatccgggtcttgaacatccaaggatttttttttttttgagacggagtctcgctctgttgcccaggctggagtgcagtggcgcgatctcggctcactgcaaactccgcctcccgggttcacgccattcttctgcctcagcctcctgagtagctgggactacaggcgcctgccaccacgcccggctattttttttttttttttttgtatttgtatttgtagtagagacggcgtttcaccgtgttatccaggatggtctcgatctcctgacctcgtgatccatccacctcggcctcccaaagtgctgggattacaggcatgagccaccgcgcccggccaacatccaaggattttggtgtccaaagggaggcctggaaccaatcccacacggatactgagggacaagtatatcatcccatttcatccctacagcagcaacttcatgaggcaggagttattagtcccattttacagaagaggaaactgagacttagggagatcaagtaatttgcccaggtcgcacaattagtgatagagccagggcttgaagcgacgtctgtcttaagccaatgacccctgcagattattagagcaactgttctccacaacagtgtaagcctcttgctagaagctcaggtccacaagggcagagatttttgtctgttttgctcattgctccttccccattgcttagagcagggtctgccacgaagcaggttctcaatgcatagttattaaatgtatataagagcaaacatatgttacagagaactttctgtatgcttgtcacttacatgaatcacctgtgagatgggtatgcttgttccccaatgttgcagatgaagaaactgaggtgcccagagtcactgatgcatggctcaagcgtgagagctggactctgaaacccaaaagcccatgcccagaaccactcccctctcttgccctcttcaagggctggcctggctccccatggtgcctgcacacgccaaccccttttcttttctctcttcttaattttaaatctattttgcaaatgtaacatctgaccattggtaaattgctaaaatttcaatgaatatagttaataacaatgcaccaatgtcaacttcttggtaatgttaacaatagtggaaatttaatgaggagtagaggggaattctttatgctctttgcaactcttcttaaattttttttttttttttattaaagatagtgtctcactctgtcacctaggctggagtgcagtggcaccatcatagatcactgaagccctcaaactcctggacccaagcgatcctcccacctcagcctcccaagtagctgggaccacagctgtgtgccaccacatctggctaatgtttacattttatttttgtagagatggggtcttgctctgttgcccaggctggtcttaaactcatggcttcaagtgatcctcttccctcagccttccaaagctccgggattacagacatgagccaccacatccagccacattttctagaaatataaaagtattaaaaaaaaaaagtatatttaaaaacccaaacaagagaaaaggacatattaggtgaaagttgattctcccccaacactgactccccctacctgagtccctcatgtccttccctaaatgcagcggctgtgacccaagtatattccaatgactgaaatgaatagcacccccacccccagcccttcatttaattgcctttgttatatgagctgggttgaaataatcgctcaaaatggctgattcctctttgagtaggacttaacccatggctgagaattgtccttctagcttgagttctcactgaagtttgaatgagaaccgtttgttgagggaccctgggaaccacatcttgccaagtcattttacatcctatccaacacaggtatgaggctgaccaaaacgtcgtttaagacctttccaacgcaaaggactggaattctattctacaacaggggatgggataggtacccccagtggtactttcatgcttgtaccatcaaacagcaatgaatttcccttcaggaaagctacgcattttctccccaattatcaacctttttgattacctaaaggagaaagccacaatttggtgctagctttgtctttaatgcccctagtacttgctgattcaccttgttaagaaagaaaattcaagcttcattctgaaccttaagcaggctatagtatttagcaagaatttaacagtattgctttgtttcctcaggtttattttcatggctattttctaattatgccaagtaagagtcatttattgtctgtggatgtcatgggacatttccgttagggagtttgagtaaaaaaagtcaatgtcggccaagcgcagtggctcacgcctgtaatcccagcactttgggaggccgaggtgggtgggtcatgaggtcaggagatcgagaccatcctggctaacatggtgaaacccgtctctactaaaagtacaaaaaattaggctggtgtggtggtgggcgcctgtagtcccagctacttgggaggctgaggcaggagaatggcgtgaattcaggaggcagagcttgcagtgagccaagatcacgccactgcactccagcctgggtgacagagcgagacgccgtttcaaaaaaaaaaaaaaaaaagtgaatgtcatgacatactgagtggtatatgacagagtacagaatatgtagctggggtaaattctatgcagtgttgagagttttggaaacactgttttgtagctcttttgaccttagagcatgggcattgggatcagatagatctgggtttgagtttcatttctaccactcattatagcactgccccaattgccccttagaactgatgtttacggtgttttgttttgtttgaataaacacaaaaatttaccttcctaatcttttgtttttcttttttcttttatttttgagacggagtcttgctctgtcacccaggctggagtgccgcggtgcgatctctgctcactacaagctccgcctcccaggttcacaccattctcctgcctcagcctcccaagtagctgggactacaggtgcccgccaccacgcccggctaattttttgtatttttagtagagacagggtttcaccgtgttagccaagatggtctctatctgaccttgtgatccacctgcctcagcctcccaaagtgctgggattacaggcgtgagccactgtgcccagccccctcctaatcttaaaattttagaaagttacattcattttacctgagttcctttctcaagaaactgacctctcggccttccagatagtattaaggaattgaaatttaccagatcactatatgtggacaatgagatgccagactcctcaaccatcacgattgcctaaccaaccacctgcatcctgttgaccagattctcttccttaccccttcctaataatttcccagaaaaaaaaaaaaagaatagggatgtatcacaatgtaacacatggttgcgtttcttccttgctacctctaattttagtgggttgaggagatggatttgagtctctttccatctcctcagctgcagcacccaattaaagccttctctggcaatactcattgcctcagtgattggctttctgtgcagcgagtagcaggatctagacagaacccttgatgttgctgcaacaattgagtgagtgagtttgaccaatcacttatgacctctctaagcctcattttattaatctagaaagagaggttgatatgagctagatcatggctccggtaaacacccaaaatgagcaagctctggggccagtactaggcacgtaaagttataaagcagaagtaaaggcagaggttgtgcagggcaccctgagcttaaattcctaccatgacccctgattggaaaagatgggctaggaaaggtatctctctggtccccagcagtttaaccctccaagcttgtatttaaactagaagtttttagatcaccagccctcatcctctatcacctccaccactcctgtccctgggtagccttactttttgttttgttttgagatcagtgattaaacctgctggtgcataccagggctgcccgggtgctcagctcttgtttgctggtgccaccgctcaggaagcatgcatctccctggggtggcatttggggatgggaagatggatttagctgcctcttcccccagaagtgactcagctcctggaagctcaatgacagcagtggcagttggagccctggggacgtctgtgccttcatgctttgctgtctccacacagcaagcaagctcttgcttggaagtgtgcgtgagagacttgttgtctctagccagcttgaaatgctcctcccgtttcttcccgtgatttgtcctcctcgtggagacattccttggcagctgtcggatgcctgccttctagttggaaaatgtgatcaagaaaggaacagtctagcaggctaatttctatcacacaagttcagactggaaagaagctgactgtgtgtgatattcatttattcaggtcctgtatcagcatttttcactctgatctgaagacctccttcattaaggtccctggacacaacaccccaacccaggtttatcctaatccttggaggtggaggcagggaattgtttcttaaacaacctccctagatattcaccttgcccactgatgtctgggaataactactccctctgtgtctaaagcaatacagtctactcagttttgttatgatgatgatggtacttacgtagggaggtagttcttacatgaatatggttgattacaacaagagctttggagtaagagagatcttgttttaaatctcacctccatcacttactccctttcctgagcctcgacttccccatctatgaaatgggataacagcactgaccacccagggctgttttgagaatcagataaggtaatgcacaggtgctggcatgtgataaatgctcgataaatgttagttattatcgttactgggtaaacctggctttcctaacttttaaactggagagattacagtataccacccagggaaggggttggccaactttttctataaagagccaggtagtgaatatttgaggcttcgtgggccagggagtctctgtggcaactactcagtttttgcaatgcaaaagcagccataaatgacatgtaaatgaatgagcgtgatcagtgtccagaacaactctacttacaacatcaagcatggggctgcgcttggtcccctggccatagggtatcaacccctggcctaaggtattgtgcagactaaatgagatgagattcattcctgtaatcccagcgctttgggaggctgagatgggcagatcacttgagctcaggagttgggagaccagcctgggcaacatggcaaaaccccatctctacaaatagtacaaaaaaagtcactgggtgtggtggagtgaacctgtaatttcagctactcgggaggctgaagtgagaggattgcttgagcccgggaggttgaggctgcagtgagccaagatcatgccactgcaatccagcctggaagacagagcgagaccctgccccaccaaaaaaaaaaaaaaaaaaaaaagatgaggtttacaatgagcccaacacagtgcctgatgcagagacagctcatggcaagaaaggattctaacgatttgtatctgattcaagctttaggcttcgttcctttctcttggggaagaaaaacatccttgagcaagacttttcaacataggtctttgttccattctttgccccaaatccaagctaagcacctggagcctggcaccaccgcctccatcctcccccggggatggaggtaaaatgccagttcctgggatgtgattaattctcttcgtcccacgcctcgccccagggtgtgttgccgttttcagcatctgtcccatggaaatcaggttgcccatctgaactgtgatgagaaaaacaaggatactcatatcgtggggtggttaactacgcactttcgcaggcacaaatgcattcagccctcaccaggaggctggattacgtggttaaggtcacgtggttgtggagtggaaggggggtggggggggagagagagagcacaagctgggtttgaatactatctctgcaatgatctggctgtgtgatgttgaacaagtcactttccttctctaagcctcagagtcatctcagtaaaatagagattaaatgagataatacacagaaagcctccagcacaggtaactattgaattcttgtacagaggaggaaagtgacgcaaagacataaagggactcattcgaggtcttgcggctgatgactagtgtcaaatgaggatttctgacactgcccccgcctagctgttttttgccagaccccacttcccccatgcacttccctcaccccctggtgactcccgctgggacccctgctgcttccagccaaggctgtgctctgtgtgcaggatctcaagcccctggagagagtgacattgttgtcaggaagcttgcaaggctgtggccattcattcttgtgggtttgtggcctcctgaagttcatgtgcatcttaaaacatcagaatgtgaccttatttggaaataaggtctttgcaggggtaattcagatcaggatccagatgagctcacattggattagggtgggccctaaatctaatgagacagaaaagaagacacacagagccacccggaggaagaacctgtgaaaacagaggcagaggttgaagtgatgctattacatccagtggcaaaaaccgtaattacttttgcaccaacctaatactacaaaccaaggagccagcaggggctgcaagggccaagaaaagatccatccctagagcctctggagagcgcgtgaccctgccaacaccttggtttccgacttctggcttcccgaactccaagagattaaattccttttgttttaagcctccccactggccatgaattgttatggcaccacgcttgactctgagataggaatgaatggggggtgtcggacttagaacagctgcctggaccagaggcagctgtgagggtcaaaaagcatgaatttgaagccagacctggactcagctctttcccttgccagcgctgagcctttgtttctttgcgaaaatgagaacctactgaacttgctggcttatggcgaggattaaaagaggtgatgggcagagcaggtgcggcggtcataacgagggcaattgcaagcatatattaaacgtgacgtgccggggtaattcatccctcacatctgttttgggtggtgggctcccttacagaggagaaacagagctgctgagaggttaaccaactccccaaggccacacagccagggaggggcagaactggaactcaaacccaggccatctgatctggtaaggctggtcttctagcttggtagcatcacagcacacagtagcactcagtattaattatctttttttttttagacgtagtctcactctgtccctcaggctgtagtgtagtggtatgatctcggctcactgcagcctctgcctcccaggttcatgtggttctcgtgcctcagtctcccaagcagctgggattacaggcacctgccagcatgccaggctaagttttgtatttttagtagagactggatttcaccgtgttggtcacactggtctcgaactcctgacctcaggtgatccgcccgcttcggcctctcaaagtgctgggattacaggcgtgagccaccgtgcccagccaatattaatatttcgatcctattcctccctccttccctcctttctcaagcctgtcctcactgcttcaatcccaggagccaccacagcatggtgtcagggacagtagtaggacccgaaattggattccaggggccttgaagcataaccagatggccccaggagatctttaggcagcacatcacatgagacatttcctacaaatcctctgcaaacagacatcgctccctctccccaagccacagcctgaggtggctcctctgacctctctccttcctgcttctctttgacactccctcctctccctccactgtgtctcccttttcacccttccctggcagaggctcggccaggtggccagataatcttcgggacccgccatctttagaaggcaaggaggaggtgattgtgaatctctccaatttcatgtttttcccattcacccacctccactctcttcctcccacttatacagttgttcagtgaccccctctccaacccaatagcagattctgcactatttatgttctgcacttatctatttcatgaagtattgttgctccctgaaaatataaaagaagcacacattgctctgagatgctgaactcaaagaggagaaaatcttcaataggctgatgactgacaggtcaaatattttcctctccccatataattgcttggccttttccattgcctttgttactgtttctcttgaaaactgggagttgtcaggccaggcacggtggctcgcgcctgtaatcccagcactttgggaagccaaggctggcagattacctgaggtcaggagttcaaaaccagcctggccaaaatggcgaaaccctgtctctactaaaaatacaaaaaattagccaggcgtggtgacatgcgcctgtagatccacatacttgggaggctgaggcaggagaattgctggagcctgggaggcagaggttgcaatgagcagagattgcatcaccacgctccagcctgggcaacagagcaagacttgctctcaaaaaaaaaaaaaaaaaaaaaaaaaagggggaattgtctcagagagaatgaagagaggccattcatttcaatgtgagaatcaactccagagaattaccttctttctgtctctttagcaaaataaggtgttttgattggtggaggggaagcagataattttggcacatggaacggacacatcacggggtaggtaatggaaaggaactccaatttactgagaatccaacgtctgctgaacaactcagggccgggagagtcccacaggtggacaaatgcatcaggtggactcctagaagagggcgctgttctatctagagatccaagcaggtagggactgacttcagggaagcctgcaaatcacagcgccctaaaccctgtgcacgtgtgcaagggccagggccccaggacatagaaggcagttggacaggtagaaacaggacaactttctctgggcacagtgactcacacctgtaagtaatcccagcattttgggaggctgaggcaggaggattgcttgaggccagaagttccagaccagtctgggccacatagcgagacctcatctctacaaaaagaaaaaagaagacctggtgtggtggctcacacctgtaatcccagcattatgggaggccaaggcaggctgatcacttgaggtcaggagttcaagaccagcctggccaacatggtgaaaccccaactctactaaaaatacaaaaattagctgggcatggtggcacgagcctgtaacccaagctactcaggaggctgaggcaggagaactgcttgaatccgggaggcggaggttgcagtgagccgatattgtgccactgcactccagcctgggcaacagagggatactccgtctcaaaaaaaaaaaagagaaaaaggaaaaagagaacaactttccaaatcatgggtataaggtataccaactttcattattccttgagtataaggaaaaagacagacgcccttgtagaactgaggtgtggggtgggctccatcttgggggcgggtgtggaaggaattagcagatacagatgatgtgatggtgtctcagggtacgccaaaaacatctcctgccccgagtctcccccactaccgatcaaaggccttgaatagcacatcacttatatctcagccattcaccctagaaacatagcccgaaggaaccctgtagatgtgtgcgaagttttcactttgagaacgttcttcactggaacattcttacggtgaaaataattcttacatttttttcctcatgattacagtggggaaaaaataggaaacaacctacatgtctgtggattgcttaagtgcttcgtgatacagccacaaatagaaaaccgccccgccttccatgctgctgccgaggaagaccatccaaggacaggcaggagcgctcaaggcatgttgctaggtgaaaagaacacataacgaaatagtgaggtcctaactttatattagaaaaataagacctacatcacagtggatatatgtatatgcatataatagtataaatatacattcacacgcatatatattaacattttaactgctaacattttagtggactttttcagtctttataaagtgtgtctgcccaggcgcggtggctcatgcctataatcctagcactttgggaggctgaggcgggtgggtcatgaggtcaggagttcaagatcagcctggccaacatggtgaaaccccatctcaacgaaaaatacaaaaattagccgggtgtcgtggcataaacttgttatcccagctacttgggagactgacgcaggagaatcactcgaacccgggaggtgaaggttgcattgagccaagatcgtgccactgcactccagcctgggcaacagggcgagactccgtctcaaaaaagaaaaaaaagtgtgtctgtgtatattacacatattatatatataaaaaaccacatatattcatatatgtatatacacacacatatttatatatccgtatgtatgctcacgcttgtaatcccagcacttcaggaggccaagttgggaggatcgcctgaggccaggagtttgagaccaaccttggcaacatagtgacacccccatctctacaaaaaaataaaaattaaaaagttacctaggtgggcctgtagttccagctacttgggagactgaggcggaagggtcccttgagcccagggttcgaggcggcagtgagctatgattgcaccactgcaccccagcttggatgacagagtgaggcctagtctccaaaacaaatgaaaaaatacttaacactacttggtagtagtattactataagataattatgataaaactttcttctgcctagagtcggctggtcttagaggcttagaccacagggcaaagtggtcgtggtcagggggagcagaggcttagaatctgggaccaggcaggagctgacaaggccttaatcaggcttttgtgagcccacttgtgagcctccactagccatcataacaaagttcccagccaggcgtggtggcctcacgactgtaatcccagcactttgggaggttgaggcgggcggatcacttgacgtcagcctggccaacatggtgaaaccccatcactactaaaaatacaaaaattagccgggcctggtggtgtgcacttgtaatcccagctacttataaggctgaggtgggagaatcgcctgaacctcagaggcagaggttgcagtgagctgagattgagatcacaccactgcattgcagcctgggcaacagagcaggactgtgtctcaaaaaacaaaaacaaggccgggtgcagtggctcacgcctgtaatcccagcactttgggaggccgaggcgggtagatcacaaggtcaggagatcgagaccatcctggctaacatggtaaaccccgtctctactaaaaaatatacaacaaattagccaggcgaggtgtcgggcacctgtagtcccagctactcgggaggctgaggcaggagaatggcgtgaacctgggagatggagcttgcagtgagccgagatcgcttcaccgcactccagcctgggcgacagagccagactccgtctaaaaacaaaacaaaacaaagcaaacgaagtaaattactttggaaaacacattttctggttcccaaagggtgtgctcacgaatacacatttgtggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgtgagtgttttggggatgtggccaaggaaagaagtgtgtggaggagagaggaaaacctaatatttgttgatcgtctactgtgtgccaggcactgagataaaggcattatgcacgtttttaaaagcctcatttgattctcaccaccacccagggaagtggatattgtcatctcctgttttaagcaagaccctgaagttggaattgaattcaggccaatctgactccaaaacctttgttctttctgtatcacccacggggaagaaagagggaagggaatgcagaggctgtaccctgtgctggtgtctttcacgagcgcacactctgctctcagataggcctgagttttttttaagcctgtcagcttgggcaggttacttggactctctgaatttcagttccctcatttctaaaatggggaaaaataacaagatggggtctctagcaacatcagagtcacatgggttgaacgttcattatctacagagcacagcattcctgaagagttgcaggtagtctttcaagacaaactctcatttaaaaagttgggctctgagtgtgtggtggtgcacacctgtggtcccagctactcaggaggctgaggtgggaggactgcttgagtcctggagttcaaggctgcagtgagctatgatcgcatcaccacactccatcttgggtgacagagagaggcactgtctctaaaaagcacaaattaaggccaggtgcagtggctcacacctgtaatcacagcactttgggaggctgaggcgggatgatcgcttgagcccaggagttcaagaccagacagggcaatgtagccagaccctgtctctacaaaaaataaaattagctgtgtgtggctgtgtgtgcctttgtcccagctactcaggaggatgaggtggggggatcggtttagcccaggggttcaagactgcagtgaactatgatcataccattgcactccaacctgggagacacagtgagagcctgtcgctaaaagaaaaaaattaaaaatacaaaaaatataaaaacatcaaattaaaatgaaaaagtttttttaaaaattgggcttttgccgacaaacagtgaaaggttacaagcaaaaccaaaccaaaccagaggttaagaggcaacctggctggaaaattccctgcgctgcctgtcagctcacccacccacccaccctccactggaagcagcaggaacatcaaatcttttaggcaggctaggcccctcccctattctttcactgatttttcacaacaccaagaggctgagtctgtgatcatcccattttgcagatgaggagactgaggcttgaagaaatgaaacagcctgcccaaggcctcccagctagtaaatggggagttagggttcagactcagctctttctgcttttaaaacacctcttctttataaatttttagttacttatttagataaagggtcttgctctgtcgtccagggtggaatgcagtgaggccgtcatagctcactgcagcctcgaactcctgaaagcccatactctcactgggacgttatatgaccttccctctcgccacataaaatgaactgcagtattcacagctgtcatttatccagccctttgcatgtgcaagaccgtgagctaaatgcttcccatgcataattccttttcacagacatctctgaggaaggttctagaacatttccacttcatggctaagaaatatcttcccttttgtctggaaataagctaaaatgatacgtgagcattcagaaacaatcctttcctccctgtgttttaaaaggaagacagagaggccaggtgtggtggctcacatctataatcctagcactttgagaggcggaggtaggtagatcacttgaggccaggagtttgagaccagcctggccaacagggcaaaaacccgtctctagtaaaaatacaaaaaatttagccacgtgtggtggcgtgcgcctataatcccagctacttgggaggctgaggcacaagaatcatttgaacctgggaggcggaggctacagcgagctgagattataccatttcactccagtctgggcaacagagagaaactatcccaaaataataataaaataaaaggaagacagagaacatgagtcttgcttttaagtaatcaagatcaagatccctttgtttaaaaaaaaaactacaaaaatacaaaaaatttaaaaatacaaatacaaattaaaaattttaaaaatatatatttatttttatttacctaatggtgctgctgcaggaacaatggttaccactgtgcacttactgacctttactgtgtgcgcgtgtgtgtggatatttgtgtggatgtgtgtggatgtgtgtggatgtggatgtgtggatgtgtgtgggggtgttcgtatgtgggtgtctggatgtgtgtgtatatgtgtattgtggatgtgtgtgtgtggatgtgtgtgggtgtgtggatgtgtgtgtgtggatctgtgtgtgtgtatgtgtgtgtgaggatgtgtgtgtgcatgtgtgggtgtgtgtgtggatgtgggtgtgtatgtgtgcgtgtggatgtgtgtgcatgtgtggatgtgtgtgtgggtgtggatgtgtgcgtgtgtggatgtgggtatggatgtatggatatgtgtgtgtgtatggatgtgcacatgcctgtcacttagcccaggcttaaggacaagaataactagcatttcttaagaggcagctctgcagtaagctcttgacttgtgatctcattgaatgtcctcatctagcccatgaatctgaccacttagggacaaatgtcaacagtagaccctaggataaatcaaattatctaaaggatacagaaggacctgagtgttgttaggacatagatcagggattctgtgacattttccaggggagggacccccttccaggcccccagatgtcttgctggaatggagtcctacagacagtattggatggtgatgacgctccccaaccaggctcagccttgtatggtgtgtagcttgcccagtggtgcacctgcctcatcaatctcagagatagacggtggacactaaggcaaccaggacaaaggacacagtatgctcagatctgcacaaagtcctcatccatcatcctcagccctccaggccaacaggctttgagccaaggccctgcttgaattcactttcttggctgttcctcagagatggtttttcccgaagctgtggggcttatcctgtgagtgtgtcctgttcttatctccattttggatgggaagtaatgggaggttacaaaatttgcctgatgctgcattagctaataagtagccaagctaggatgcagtctgactccagaatgtttattaagtgaatcagggaaggagggaagggagtgggagagaagggagggggagagggaggggagaggcggacaggggaagggagggaagggaggaaagaaaaggaggaaggaaggaagctttgagtataaactaccaagataattccttcaagtttataaactccatgagggcagagaccttatccaatttcctcacaacgtcttcccagcatttggaacaatgcctggcactgagtgtcatgaatatttgtcaaatgtgcaataaattattctttctcactccatccttaccccaacaatcctcttacacacacacacacacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccttaatgcccatcagctgctgcagagaccatgtgagtcagcccctatttcatggttgagaatgtgtctcacttccaatgcttctcgcagcattaactcttttatttttatttcttgtgacagagtctcgctctgtcgcccaggctggagtgcagtggtgcgatctcggctcactgcaacctccgtctcctgggttcaagcgattcttgtgcctcggccttccaagtagctgagactacaggtgcccaccaccatgcccagctaatttttgtatttttagtagagacaaggtttcaccatgttggccaggctggtcttgaactcctggcctcaagtgatctgccctccttggcctccttgggattacaggtgtgagccactgcacccagcctgcattgactcttttaagcatgagtccgggggggactgcctgccccagccccaaagctctggcaccctcacatttagattatttcatgggcttcctttttctcagctgatttaacttgtcctttcccccaagatccacagcccctgcctgttcttcctcttttcctgccacgacagtgaggaagaagaggagggagatttccctactcccagggaatggtgagaactcgggagatgtgggatcagaggtcatcatcctggctctctgacgtccttggtctgtgaccttggacacatgagggagcacacagagttgctgtttcccgcgggcactgatatgccaccctgagtgctacgtcccctgcatgcattcaccccttaattttagcttcttgagtcctcgcaagaaccccaatagagtaagttctatctcttttattttatgaatgaggaaattgaggtcggagaggcaaagtgacttgttcgaggtcaccagctaggataaagtagtaccaggatttgaacccaaggtgtctgtctcgtgggggcagagcccttaaccttaagctgttctgttatctttattctcaatgccaggaccccttttctctttgccttactcttttacaacgcaaggacaaacccccgattagatgcccccagtcccacacttggtcttgtcttgttctgcaatgttgaattgtgtgtggtggaacttggacagattttactaagtcaggctttggacttttctgtaccattgaaactgacccaatagtcccatcatagatgttctttttttttttttttttttttgagacaagagtctcgatctgccacccaggctggagtgcagtggggcacgatctggactcactacaagctccacctcccgggttcacgccattctcctgcctcagcctcccgagtagctgggactacaggcgcccgccaccacgcctggctaacttttttttgtattttttagtagagacggggtttcaccgtgttagccaggatggtctcgatctcctgacctcgtgatcctcccgccttggcctcccaaagtgctgggattacaggcatgagccactgcacccggcccatagatactcttttggataaatacagaagttgacctttctgatcttaaagcttgaagccctcatttgtcttatctgagttatttcctcaggaagggacccccaggcctctcaaaaaatatcaaagaactgaaactcaccagattaccacatccagagatgagataccagacccctcattcatcatgattgcttccttgctcctcccgagttcctgttttcttcatgattgcttccttgctcctcccgagttcctgttttcttatacattgttacatttcttccctgctatgtaaactcctagttttagttggtcagggagatggatttgagactgagctcccatctccttggctgcagcacgcaattaaaatcttccttggcaatactcatcttgtcagtgatgggctttctatgcggcgagcagcaggacctagaccaaacccctggtgtttcagtatcaccatttctctgcacataaactgtttatttcagagaccaaaatgatgagctccaatgcagacagtcaaagtttgtgaagtcagtctgctgggaatgtgctgtagaaaaagaacccggttcccgtaataactcttaaggcccacaacagttggcatttacagaccccttattgtggacctaggcttgtgctaagccctttacacacatgctcacataacccacatcaaatgcttactaacagaaagatgcatcaggaaccaccccaacccaggacacccacttgccctgaatcaggcccaggaggtcaagttcacagaccagccataagtgagctcccagcaggcaggtgtgaactctgagtgtgctcctcactctgaatttccagtgtgtgttcccttgctgacttccctttgcttgacccctggtttccaatgtgcaaaatggcatttagagatctctttcttgaggcttggcaattttatcaactttactggaacagggcagtaacacaaaactgcctccggaaaacaggcagcaaacatctggcagataatgcttgaaacgcctgtgttttctcacttcttgaccctatgttccacccacctcctagtacctcccactgctaccccatctccctacccatcctgcccccatcttactgcaggcaagaactctcagaggctgtcaacaacctcagactcattttctcgccttccttccagcactgaatcacatcattagtttttaataattcttcttgcagcccctctggctcgcttcagcttttccacatctagtctaccaacccgctcctgctgtttatctgggtttcagataattaagtatctttggcctccacatggggcaggggtgtggttatcttccttttacacccgcttgctggattttcataaaaagggatagcatgccctgccactcagcttgctctgggcaaaagcaggttttaatcagccagagacagaactgcagcaggcagggaaggtaggcgtgcgaaggacatatttcaagagcacagcctttgagttccaatatttccagagcctgggcttgaaatccagtaacttcgttttattaagaggtaccaagtgtggtaaagaggacaggccctgggaacctggcagagattcaaaatggggtaatagtgcatgcattgtgttgaaaaccacacacacacacacacacacacggaaagtgtgtgcattgtagatagcagttcttttaaaacattttctatgctggctagttttctagtgttttattgttttgattcatataatcctcactatcaccatccaggcagaaaatatcacatagcctttattttatagatgaggaaactgaggcactgagaggtcaagtctcttgcccatggttgtacagtttccatgaaatagcattctaagtccagatgaaatgggaaaagttcccttgtccccctcgcagggtgtgtgatgtcggagtggctcgcttcttcagtgccccgctgctcaaacctctaggggaccatagagatgggccagttgtcgggatctgatcccacggcagtgtctaggggtggatgtttacaactcctgaagcttcagtgtgtgtgtgttacatggtgctcttttagttttgctatctataggcggcttgtgttaactagctcaattagaccctctacgttgtcccaaggacagagggctttctgtatcctgggttcttgccttggtgcaccagaagaatcggatcacacctggacttggagaatgagagcaaggttttattgagtggaggtagctctcagcagatgggggaagccagaaggggatggagtgggaaggtttccccctggagtcaggccgcccagcagcctgggcactcctccgactgcccaggccaaactccactttgttccgccagtagatggcctgccagcatctgtcatgtgctcttctgccagcgtgttcctcttgacgtcttcttgacatccagacgcttgtgtcttctttgccgatctgcagctcttgacgtccagcagcttgtgtgtcacctgctagggtcttggggtttttatagatacaggatgggggcatggcaggccagggtggtcttgggaaatgcaacatttgggcaggaaaacaaaaatgcctgtcctcacctaggactgtgggcacaggcgtgggggtggagcccttaccagggaccacaccctcctctacccagcacttcccttccttccttctgtagcatttaaagcgaccatgcccttcccttcctatcacctctcttgcatatcacagagtccatggtctcagtcatcaagctgtggggtctctcaactagctttgaattctacttcttaccaactgtgtggcctggagcaaatactttgtcctgtttcagcctcggcttccccatcagtacaagggggacagtgatatctccctgcagcatcatagcaagggatgaaaacagacacaggtatgaaattgggtggcccttcctaggtagtaagcaattcaaaattcccttctttcctttcattgttaacattgtgcttcgtgggagagtagggcatcagggctgcttatggttgtctccagagaattcccagaaaatattcctctccccaagagaagatgggattcactgtggtttccttgagatcctcttgggaggtgccaactctcttgagagtggctctcaaccattaagtgcaactctaccctggggccttgattttattatgatgattatttaagatttttttataaacctgcattttttcccctttaatgagctgataattctgaagtctgttaggaagagcttcaagccaagggcaaaatgaagcatgtgcgtttatgtaacttgacacatttcagccacattcaggagctctgcgtcactttagttgcacacagggttttaaatagcatcttccaggaacaggtcaccattgccggggccactgtacatatcggatgggaagagatgcccttaattgcagaagatctaagaagcagtttgtcttggacaaaatatacaagaagttggggtgtaggggagggaaaggaaggaagaagaaacggagagactaaagggaggagagaggagggagaatttctaagctagacttctgaatggaaggaccctcctcctgaatttctaaatgtactgggaggtggggaggaaggtgggaatctgtgttgattgaatggagaaatacatgttagtctgggcgcagtggctcatacctgtaatcccagcactttgggaggctgaggcaggtggatcacctgaaatcaggagttccagaccagcctggccaacatggcaaaaccccatctctactaaaaatacaaaaaaattagctaggcatggtggtgtgcacctgaaatcccagctactcgagaggcttgaggcacaagagttgctttaacctgggaggcagaggtttccatgagccaagattgtgccactgcattccagcctgggtgacagaatgagactctgtgtcaaagaaaataaataaatcaaataaatgttctgtacttgacaagctcttgctgctacgagttgcctttcatggtcagaacaagtttcgagaaggaaaatactctctagaagttccgtcttcctagaactgtattacattctgctcagaggaccacctctgaaccacctagactccattgggttgggagggagattaccatgtaagaccctggtgattatcaattttatgcatcaacttgagtgggccacagggttcccagatgtttggccaaagattcttcgatgtatgtgtctgcaagagcattggtggatgaaattaacatttgaattggtaaactgagtaaagcagactgccctccctaatgtagaggtgggtgggccccgtccaatcagttgaaggcctgactacaacagaaagggtgagtaggagggaactcctgctgcctgattgcttgggctgggacatgggtcttttccggcctttgaacgcaaactgaaacatcagctcttcttgggtcttgagcctgccagcctttggactggaacttaacaccgtcagctctcctgggtctccagctgccacctatagatcttgggacttcttggcctccaaaatcccatgagccaattccttatcataaatctttttccaggccaggtgcagtggttcacgcctgtaattccagcactttgggaggccaaggtgggcagatcatttgaggtcaggagttttgagaccagcctggccaatgtggtgaatccctgcctctactaaaaatacaaaaattagccggctgtggtggcgtgtgctttcagtcccagctactcggaaagtcgaggcaggagaatcgcttgaacttgggaggtggaggttgcagtgagccaagattatgccagtgcactccagcctgggcaacagagtgagatcccatctcagaaaaaaaaaaaagaaaaaagaaaagaataaagaaaaaacaaataaaataaatctcttcagtagtattggttctgtttctctggagaaccctgactgatagagccctttttattctcagaaattttcatttggatagtttatcaggttagcaaagacctagcaagttggataaaatgaaaatatagggaaattggccttatctctttggaaaacagttcattgttacctagtaaagatgaacaggtgattataacctgcagttttgctcctgggtctacccctggttagccagtagcttcatgtggctatttcagtttaaattaattaaaattaaatagcatgtaaaattcagtctctcggtagcctgagccatatttcaagcactcattagtaaataatggctagtggctaccctattggaaagcatacatttgtataggacatttctattgttgtagaacattctattcaccagcactgccctagagaaactacacatgagcatcaggaggcatgttccagaatgttcataactgcctcgtttgtggtctagctgtaccacagaatactatacagcagtgaaaaatgaatgagcaacaggtatgaacatgaaagcatctcaaaaacaagatgttgagcaacaggtttatataaagtgtataaaagtaaaaaatataggccgggcgtggtggctcacgcctctaatcccagcactttgggaggctgaggtgggtggatcacaagttcaggagattgagaccatcctggctaacacggcgaaaccccgtttctactaaaaatacaaaaattagctgggtgtggtggtgtatgcctgtagtcccagctagtcgggaggctgaggcaggagaatcgcttgaacccaggaggtggaggttgcagtgagctgagatcccgccactgcactccagcctgggcaacagagcgagactgcatctcaaaaaaaaaaaaaaaaaaaaactaaaaaatataattgttccgggcttcatatatgggtggtaaatgataaaaataaaaagcattaccacaagtttgtgatagtgcctacctctgagggaatgagaaaaatatgagggaatggggcacacggggccgtctaaaagtcacacacagatttttacttaagtaggatgttgggaaaataactgctttattattccataaaaataatataataataattctatgaagtatgaaataatagtaaataataataaaatataataaatcatattttattatattttattattattatagtatattttatataaattttactataaaaataaaacattttatgcacacttatatgtagtttgcacacacacttctattttttaaattgtggcaaaatatatataatatttactatctgaaaccatttctaagagtacagttctatgtcattaagaacattcatactgtgtgtaaccatcaccatccctccccagaatttttttcatcttcccaaactgaaactctgtaccattcaacactcactccccattttccctttcccctggctcctggtaaccagcattctgctttctgtctctgattttgatgactctacatacttcataaaacaggaatcaggccaggcgctgtggctcacgcctgtaatcccagcactttgggaggccaaggtgggtggatcgcctgagctcaggagttcgagaccaccctgggcaacatggtgaaactctgtctctactaaaataccaaaaattagccaggcgtggtggcgcacacctgtagtcccagctactcaggaggctgagggatgaaaatcacttgatacctggaggcagaggttgcagtgagctgaggttgtgccactgcactctagctcaggctacagagtgagaatccgtctcaaaaaataaaataaaaaaaaaagaagtggaatcacacggtatttttctttttggacacacatttctaaggggaaaatgctgagaaagacaggcaggggaaggtacagtatctgatatctccacttaaatgtctcaaagatacctgtaactcaatctgtccaagtcaaactcatgatccccccatctagtcccaatacccaccagccctagctcagcaaatggtcaagcatcaccatctatccatggaaatctcaaattccaaaattagacatcattcttgacccctcccaaccctccacctcatatattcagttcatcatcaactggtgtttgttttacctcctaaaataatgctcagctgtccatctttctccatctccatggccaccacccaggttcacatgcccatctctgtcctgcagccagagggattttctcaccatgtgaatctgattataactctcagatttaaacactgtcttagtccgttcctgttgctgtaacaaaattccttagactgggtaatttataaatagaaatttaattctcacagttctggagtctggctgggaagtccaagatgaagatgccagcagattccatacttagaagggctcattctctgcttccaagatggcgccttgcttctgtgatctccagagaggaagggcaccgtcttctcacaagcagaatggacagaagggcaaaaaggactgaacttgctctctcgagcacttttgttagtgcactgatcccacctcctaatggccctcaccccttaatactattgcattggaaattaagtttcaacatgaattttgaagagtcataaacatttacaccatagcaaacaccttccagaatttgttagcatgataaagcccatgagatcttgctggatctgctcacacctcttctccaacttcttttcttcatccattcctcacccccagctccctcccttacacacacacaccactcccttgggcctccttttagtctccacctccccaccccccgatacacacaccaggtcccctcctgccgtgggggcctttttgtttgtgatgttccctctgcctggatccctctcctcccacccccctctccttccctggtgctatgatctgaatgtttgtatcacccctaaatacatatgtcgacatctaattcccaatgtaataatatcaagaggtggggctttcaggaggtgattaggtcatgagggcagatcctcatggatgggattcgtgcccatgtaaaagaggcccagggtagcttgtttctccctttcactgtgtgaggacacagtgagaactcactatctatgaggaagaggtcctcaccagacactgaatctgctgacaccttgatcttggactttccagcctcttttaccatgaaaaataagtgtttgtttgtttgtttgtttgtttgtttgacggagtctagctctgtcgcccaggctggagtgcagtggtgcgatcttggctcactgcaagctctgcctcccaggttcacgccattctcctgcctcagcctcccgagtagctgggactacaggcgcccaccaccacgcccggctaacttttttgtatttattggtagagacagggtttcaccgtgttagccaggatggtcttgatctcctgacctcgtgatccgcctgcctcggcctcccaacgtgctgggattacaggcgtgagccaccgcgcccggcggtgtttgttgtttataagccacctaggctaagaaagggagaatggcagcccaaatggactaaggcacctgataaactctgtcccctcgaggactgagatctagggcatttctggagggacaccttcccagcacttccccagtccctgtcccattaccatccctgcaatcctttccttagaagccttttgtaaatttgtgttcattggtgtgagtgtatgttcaatatctgactctcctcctagatgctgacctccatgaggacagaggctgagctattttcactcccaaaaatgttgacggtacccagcacacagccaaactcagcgtaggcactctgagtgaagattgattgaatgaattaatgagggctcatcttcctgcttctcccacggtcacataatctcaagggttcccttccatgtggcaggtctgggtggtgagaactgcctggctctctgatggttagggtgaacagtgggtccattcataggaaggaacagagtgataatgcagctaagtgcgttattttcctgtggctactgtaacaaacagctgcaaatgtgttaaaacaacacacatttcttttatcttacagttctggaggctggaagtctgaaatcgatttcactgagctgaaatcaggtgttggcagagccgtgctttctggaggctctagaggagaagcctcttcctcattcattccagcttctagaaccgtactctttgcatttcttggcttgtgtttccctcctccatctccgaagccagcagcatggcatagtccagtccctctcgattgaggtcatcctgtcgcctttgctcttctgtgtcaaatccctctgtttttctcttaaatgtatgcctagcattccattattggaacactaagcatgtgggagttatttatatgctacttctcaaggctatcaccaggtctgatttctcaaattcaaaaaattgcaacctcaggcataaatgggtaggggcacttgtgatgacattgagggcccacctggataacccaggatgatctccccatctcaggaccccttaatttaatcacatctgcaaatttcctttttaaaaatatatatttttcagagacgaagtcttgctctgttgtccaggctggagtgcagtgacacggtcatagctcattgcttcctttaattcctgggctcaaacaatcttactgcctcagcctcccaagaagctgggaccacaggcacgtgccaccacacatagctaatttttgaattttgtagagatggtgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgtaagtttcctgaggccttccaagctatgtggaactgtgagtcaattaaacctcttttcttctttctttttttttttttttttttttgagacggagtctcgcactgtcactgggctggattgcagtggctcaatcttggctcactacaaccaccacctcccgggttcaagcaattattcgcctcagcctcccaagtaactgggattacaggcacccgctgccatgcccagctaatttttttttgtatttttagtagagacggggtttcactgtgttggccaggctggtctcaaactcctgacctcgtgatccgcccacctcagcctcccaaagtgttgggattacaggtgtgagccatcacgcccagccttaaacctcttttctttacaagttactccttctcgggtatttcttcatagcagcatgagaatggactaatacagttgggatctcatcaccttgcccaggctggtcttgaactcctaggttcaagtgatcctcccgcctaggcctcctaaagtcctaggattagaagcatgagccaccatgcctggcccaaaatcccttttgccgtgtaaggtaacagattcataggttcattaggacatggatatcttcagggaccattcttcagtctaccatattgagtgaccacagcaattcatataagggccaagcccagagcaggagccacagtgtggcagcaacaatgacagagacggccctggtgaggctggggaaaggggaagatgacacactacatggggcaccctcatagcttcatcctgtgccgggttctcatcatttttttgaaatctcccaaaaaagaagcttcttagaaagacagggcaatagataccagtaaattgcatgtaccgtggcctggcgattaagggtttttccattccctttgcttatttctggaaagctgctgatgtgagtggcagcagagattgagaagggcttgtccctatcacgtgatggtctgaattgaataggataatgcttggctgagcctccttcccacattttccttcaaataaaataccaaccctttcttgacagttctaggacaggatgcccaaagagaaatgggagggaataaaactgcaagtgacttagcagagctgccttggtgttttgggtctacacaaccagattcccgagcacccccttaaggcaatatcctgacttacatatttcatgttatgtaattggctgctattcattgagccatcagttacttagatcttgttgtctcctggaattccagtctactgtgtctgtcctcagtcccctaaactcctcggggatctcaagttatattagatcaatccaagacattcctggttgggttctgccaaacgtggtaggatccctgttttgtttttttgttttttttgtttttttttgagacaaagtctcactctgtcacctgggctggaatgcagtggcttgatcttggctcactgcaacctctgcctcctgggttcaagcgattctcctgcctcagcctccctagtagctgggattacaggcacccgccactgctcccagctaatttgtatttttagtagagaccgggtttcaccatattggccgggctggtcttgaactcctgacctcgtgattcgcctgcctcggcctcccaaagtgctgggattacaggcttgagccactatgcccggccttttttttttctttttctttttttttttttttttttgagacggagtctcgctctgtcgcccaggctggagtgcagtggcacgatctcggctcactgcaagctctgcctcccaggttcacgccattcgcctgcctcagcctcccaagtagctgggactataggcacctgccaccatgcccggctaattttttgtattttcagtagagacagggtttcactgtgttagccaggatggtctcaatctcctgacctcgtgatctgcccgcctcggcctcccaaagtgttgggattacaggcgtgagccaccgcgcctggccagatccctgttttttcattactagatatcctggtcttggatggggttgctttctgataaatagacctcgtgcctggtaagtgtgtttacttgctccggattaaattacacctagatttacattctacctctgccatttataggctgtgcaatcttgcacaaatatcttaccttctctgagcctcggtggcctcatctgttaaatagccatgcatccagtatctcgcagggtggtcatgaggagtaaaagagatcaagcatattaagtgctcagtccagtgcctgctaccacgtaagtgctcattaaatgttactttcctttaccaccaggaagaaattgagtttggaaatggatagatacaggcataagtgtagacactggtttctttgtttggaagaggagacacaagagaagggggagattagagggtggaatgatgatcttttccatgtcaaggttgttgaaacgacgagagaagtctcaaggggcacctaagatttgtctcaaaatatctgaaggatattacgtggaagaggaagttcgtttctttctttttttttttttttcctgagatagagtctattgtgttgcccaggctggagtgcagtggttcaatcttggttcactgcaacctctgcctcccaggttcaaacaatcctcctgcgtcagccttctgagtagctgggaccaagtagcagcctcaggtgtaggggggcttgagcctctcctcactcctctctgattggtccaaatttgctcagtctgggccaatcagagtctttctcctgggatgcagagagattagcccaggtggatgatgagggagtggcaaaccgaagtctatgcataagcagagaaagccagtctttgaagggaaagaggacagagcgtctgcctcaagaataacaagagagacagtgtcctttgaaagcagagaaggaactcagccatgacattcccattgcagtccagatgaactgggtagtccataagatgttgcaccttgttcaaccctgcgcatcctttctccagacccttggagaaatacctcccaccccgtgttgccaccgcctagggaaatccaaaatccagctgtacaatgtctgtacatttccaggggcttccatcctcaagtcttctctgctcctaggcttggttccttgagtcctgtacctccatccaactgaatatgaaactcagatgcttcactggtttccataacaacagaataaaacaatgccctatcctactcccacaggtcatttgaggagcaatacaatgaggatcacaaaaagggtgtcattgatctcttcacagcagacagcttaaaaaccatgaccagtgacaatcgtctcctggctcaccatgtaactgtccctccagccccagaggactagccccagccacagccctgcaaagaccttgattttttttttaattgcaaaaaaaaaaaaaaaaaaaaaaaaaaaaagaaaaggccaggcgcggtggctcacgtctgtaatcctagcactttgggaggccaaggcgaaaccctgtctctactaagaaatacagaaattagctgggtgtggaggtacatgcctgtaatcccagctattagggaggctgaggctggagaatcccttgaacccgggaggaagacgttgcagtgagccgagattgtgccactacactccagcctgggcaagagagtgagactctgtcttaaaaaaaaagtcaatgttccagtaaagggcatcgtggtatccatatggccataactaggagaactagaaatccacatttgacattcctggttaacaagatctttttcaccaccctgtgccataaggcagtggggtggtttcctttttcttggccttttccacacacggggtccagtttcatcacctctttttctcttctcctttatctcagctccctccattccaaggaagacacttacttctcctgtcttatccacagcagctttgccctcttctaagaagccacggcaccaatttatgctgagctcttgcaagtaccaccccaggtgtttgtcaagccataattccaagcaaaaaccattatctccccaagatacatatgggtaccatctgtcaagatgctagcatttcccttcattttcttacacctttactaaactatatttttctcaagtgagcttgagtggatttctgttccttctagtctgtgctgcaatattctattaaaaatttaggctgaatgcagtggctcacacctgtaatccctgcactttgagaggcttaggtgggaggatcgcttgagcctagaagttcaagaccagcttgggcaacatagcaagaccccatctctacaaaaaaactaaataattagctgggcatagtggtgcatgcctgtagcttcagctattctagaggctgaggtgggaggattgcttgagcccaggagtctaaggctggagtgagctatgcttgtgccactgcactccagtctgggcaacagagtgagactctgtctcaaaaagaagaaagagggccaggtgcggtggctcacgcctgtaatcccagcactttgagaggccaaggtgggtggatcatgaggtcaagagatggagaccatcctggccaacatggtgaaaccccatctctactaaaaatacaaaaaaaaattaggtgactacagtggtgtgtccctgtagacccagctgctcaggaggctgaggcaggagaatcacttgaacccagaaggcggaggttgcagtgagctgagatcgtgccacagtactccagcctggcgacagagcaagactccatctcaaaaaaaaaaaaaaaggaaagaaaagaaaaaagaaagcttagctataccgagaactttatttcccatatcccattttgtattagtccattttcacactggaaaaaaaaaataccaaagattgagtaatttataaaatagagaggtttaattgactcacagtttcgcatggctggggaggcctcaggaaacttacaatcatggcagaaggggaagcaggcaccttcttcacaaggcagcaggagggaataagagccagcaggggaaatgccagacacttataaagccctcagatctcatgagaactcaccctttatcacgagaacagcatggaggaaactgccgccatgatccaatcacttccctccctcgacacgtggggattacaatttgcagtgagattttggtggggacacagagccaaaccatatccttttccctgtagggttgtgggttaaaagtaggcagaagaggatggtgcgggagatttgggaagtggaaggaaggtgacatcagtgtttactctttgaaggctgtccagatgagacaaggaggtgatctgacagaggggccacagaggttccagcttgtcctcaccctcccctgtgtcccttgcagcttgtcttcctgaccgctgggcctgctgaccaacagcagcccccccgcctctggatgcttggcagacgaggcagcagccccctagggacccctctacctgtttcccctctgccactccatcttaacagctggacgcatctgactctcatatcagctgtcggtgacttctctcatcctctccacccttcccagaccgccatctccccagctccctggacaattgtagaaggtctaattcctataacgcatcccttgccccagagcacgtagtgaccctgcttccccgattgagcactgactaatatccctcaacagcctttacagaagtagccagaagttggaggcaatgtgtccatcttgcaccaggccaacatccccccatgcttccgcgtctcagccttgactgcctattgcaatcacatggagaactttaaagaaaatgctggggcctggtcttacagccagagtcttgtctagttgttccaaggcatagcctggtcattgagagtcttagaagcaggtaggctgatgccccctcacctcccacggcacagacatcccctcacctcttcgctggctgaaatagaagaaccctagtgtccatcagctgcttatagatgactcatcttcttaatcctttcttgacgaaaacttgcttcagatgttaataaaaagtacaaaatctgccctatgttagtttgactccttggcacagcagtgggagcctctctctctcccctgtagcctaggatcgtgatcagaatcataatgaaatgtgtgtttgtggtctcccgtggcgtcagataattccgatgccatctgttgtcttcatcatcacatccgttattgaagtccgttgattatgcctttgattgaacctggggctatatttatcaagaaaattataagcacaggctttctgacagtgtccaaccaaacagaatttgtcatcattcaatgactattgctttccatttgttcctgttttggacttctaaaaaccaacacagggtctccttttatttttatttttttaaagaaatcaagtgagctggccaagagcagagcagaagatagatttttcttattcttaattttttttttttttgagacagcatctcgctctgttgcccaggctggagtgcagtggcacaatcttggctcactgcaaccttgtctcccaagttcaagcgattctcctgcctcagcctccccagtagcggggattacaggtgcccgccaccatgcctggctaatttttgtatttttagtagaggcggggtttcaccatgttggccaggctggtctcgaactcctgtcctcaaatgatccacccacctcggcctcccaaagtgctgggattacaggcatgagccaccatgcccggccgagaaatatatatgtatttttaagagacgggctttcactctgttgcccaggctggagtgcagtgatgaatcatggcttactgcagccttgaactcctgggctccagtgatcttcctgcctcagccccttgagtagtggggactataggcacatgccaccatgcctggccaattttttaatttttttgtagagatggggtcttgctgtgttgcccaggctgttatcaaactcctggcctcaagtgattctcctgcctcagtctcccaaaatgatgggattacaggcatgagccaccgtgcgtggctgaaaattcttaaatgtctgccacctatgaaagcattttggagctatagtttgacccaagacgaaaactgctcatttagataatgaagtttaatttacctttgaaagcaacactttgggaaatgcctgaataaactgacatcttgagtcgataggaggcttccccacgtggagtttggtgagctataccaggtcattaaaaagcccttagatgggccggatgcgttggctcatgcctggaatcccagccctttgggagcccaaggtgggtggatcacttaggtcaggagttccaaaccagcctggccaacatggtgaaacaccatctcttactaaaaatacaaaaattaactgggcatggtggtgtgcacctgtaatcccagctacttgggaggctgaggcaccaggatcacttgaacctgagaggcggagattgcagtgagccgagatgtgccagtgcactccagcctgggtgacagagcaagactctgtctcaaagaaaaaaaaaaaaggctcttagattggaagtcagtgctctcattcccccttgaagatggtgactgtttgctactgttccatgtcttcaatgctcatgctgctgcttagacctgttagaactgaccttgagttattccagaggaaaattccagcggatcctagaacaatcagagtattctggactgaagcatagtccagaatcgctctggtgattaaattcggaaagcttgcccagggcatcattaaccgcctggaggagtgagccctctcaccatctgttgtctgccatcactatttggtttttctctttggtctcatttagagccaagttgagaaatttccagttcctctccacttgctgcccgacacagttaaccagaaacacaatgtggtgaaggggcccatgttgtagctaaaacagccctagacttggaggcaggagcctgggttgatatcttggctgtttgactttatagcagcgatccccaacctctttggcaccaaggactggtttcatggaagacaatttttccatggaccagggatggggtgggggcatggttttgagatgattcaagtgcattacatttactgtgcactttatttctatcattattactttgtaatctataatgaaataattatacaactcaccataatgtggaatcagtgggagccctgagcttgttttcctgcaacaagatggtcccatctgtgggcgatgggagagagtggcagatcatcaggcattagattcctataaggagcgtgcaacctagatccctcacatgcacagttcacaatagggtttgcactcctatgagaatctaatgcagccgctgatctgacaggagggggagctcagccggtactgtgagcatggggagtggccgtaaatgcagatgaagcttcactcactcacccgccactcacctcctgctgtgcggcctggctcctaacaggccaaggacctgtactggtggtggctcaggggttgggaacccctgctttatcagacttagttggtccagtttttcccaaagttgggtacgctctgggatgattttaggcagcatttaggaaaacattaattaagaattttttttcggccaggcatggtagctcatgcctataatctcagcactttgggaggcctaggtgggaggatcatgaggtcaagagatcaagaccagcctagccaacatggtggaaacccagcctttactaaaaatacaaaaattagctgggcgtggtggtgcacacctgtagtcccagctacttggaaggctgaggcaggagaatctcttgaacccgggaggtggaggttgcagtgagccgagatcgtaccactgcactccagcctggtgacagagcaagattccgtctcaaaaaaaaaaaaagaaaaagaaaaagaatttattttcaggcaaggcctagtggctcatgcttgtaatcctagcattttggaaggccaaagtggaggatcacttgagcctaggagtttgagtccagcctgggcaacatgacgaaactccgtctttacaaaaaattagcccagtgtgctggagtgcacctgtagtacccccagctacccaggaggctgaggcgggaggattgctggaacccaggctgcagtgagctgatatcacgccactgcactccaacttggacgacagagtgagaccctgctgaaaaaaatatatataattttcatgtcttttaggaacaatattaggtttgcatttatggtgatgtaaaaaagagaatcaacataaagaaaagtattaaatagacaataaaagagaacacgcctgtaatcccagcactttgggaggctgaggtggggagatcacttgaggccaggagttcaagaccagcctgtctaacatggcaaaaccccgtctctactaaaaatacaaaaattagcggctctcggtggcatgcacctataatccaagctactcaggaggctgaagcatgagaatcacttgaacctgagaggtggaggttgcagtgagctgagattgtgccactgcactccagcctgggtgacagagtgagaccctgtctcaaataataataataatagagagggcttgaggcatagcaactgttgccatggtaacgtgcaagtgactgatgttcaggaaacactggctttgctaccctgagccacacttttccttcttgcctgcaaggcgataaggatgttgcacctggtggctggtgtgaggaggtcaggcgcagcaagaggcagcacacgtagcagttacagtcacagactttgcctgcgccagggtctgtgtcccagcggagatgcttaccggctgtgtggtcttgagcaaattgctcgacttctctgttactctgtgtggtgttttctgacgccacttctgacaccaaatgtgttttttctgataccaaatacgtgccatttttctacactaagtctctgattcttggatgccaactgggtgcccaagcaattcaattcagctatcacactatgtcctggagttagcatcaggtcctgcaagttaaaagaccccatcccaccagactgcccctatctcagatgccagtcgcaagtccggagccacccacccttctgcctggccaattacaaacttgggggttcccacgaccacctcctcgggtttgatagtttgctggaatgactcacagagctcaggaaagcccttcacttatgtttactggtttattacaaaggacagaactcaggaatagccaaatggaagagagatgcattgggcaaggtgtggagagggagccgtgcagagcttccatgatgccctctctgggtgcactgccctcccagcacaccagtgtgtccaccaacctagaggctccctggatctcactgttcaagagcttttataattcagtcgccagcctcctcctcttcctggcaggtcagcgagtgggactggaagttgcccgccgaattgttttttttttttttttttttttgagacagggtctcactctgtcacccaggctggagtgcagtggtgagatcatagctcactacagccttgacctcctaggagtgagcctcctgcttcagcctcacaagtagctgagactacacaggtgggtgccaacatgcctggctaatttttaattttttttttttttttttttgagacagagtcttgctctgtcacccaggctggagtgcagtggcgcgatcttggctcactgcaagctccgcctcccaggttcatgccattctcctgcctcagcctcccgagtagctgggcctacaggcgcctgccaccatgcctggctaatttttttgtatttttggtagaggtggggtttcaccatgttagccaggatggtctcgatctcctgacctcatgatccgcccgcctcggcctcccaaagtgctgggattacaggcttgagccaccatacccggcctaaattttttttttttttttttttggtagagatggagtcttgctatgttgtgcaggctggtctcaaactcctgagctcaagtgatcctcctggctcagccacctgagtagctgggattacaggcatgagcctctgcatccggcagtgcccccgaccacctgtctttttttttttttttttgagacggagtctcactctatagcctaggctggagtgcagtggcatgattgcggctcactgcaacctccgcctcccaggttcaagcaattatcctgcctcagcctcccaagtagcttggactacaggcacgtgccatcacacccagctaatttttgtatttttagtagagacgggggtttcaccatattggccaggctggtctcgaactcctgacctcgtgatctgccggcctggacctcccaaagtgctgtgattacaggcgtgagccaccgtgccctgcccacccctctcccctgtctttatcacacatttgctcttctggtgacgaggccccaacctgaagccatctctctagggaactcagcctgagtgccctcattagcatacactcagatgtagtacaatggggattgctatggataacaaaagacagtcctatcgctcaggaaactccaggggctttaggagctctgtgctgggaaccagggatgaagaccaaatagatattttattaaccacactagtggcttaatgaattacctcctagggattttttttttttttttttttttttggtcaggagcagatgagataagatacataaaaaagatattacaatacctaaccacataataactgttcagtaaatgttagcagtgaaatgggggagctcccctgtcccctttgcaggacttgtgacaggggtgtggctcgcttacttggctgccactgcatcaaaccccttgcaggagggggagcatgcaggtgagcagattggggctggggtgagtgcttttgggctctggtcccatggcagcgtctagggatgtgttacaattaatactcttttagcagttgctgtacgcagatgactaagtgttaaccagttcagtggagattcagggtgatagccttttacaccctgccctcttggtacctgggttcttgtctggtgtccaggaagaatcaggtcacatggacttgaaggatggtgaatacaaattttttattaagtagtggaagtggctctcagtggaaggggagctggaaaggggatggagtgggaaggtaatcttcccctggagttcagccatcctcagatgatctcctctctgactgtccccagccaaactcctctcgatgttcagacacttcttctcttctctccttctctgccacgccactctggtgctattctgattgtggagcctggggtttggggttcttaagggcataggatgggggcagggtggtccagagcggttttggaaaaggcaacatttgggtgtgaaaacaggaatgcctgttctcatttagggctgcaggtccaggcttgagggtggagccctcacctgggaccctgtccttctgccgcctgtccgtatcagcaggatgctactgctgctgctgatacctggggaattgccaggtgtgaggtgggcattagaaaaatttcaggctgggcacagtggctcaatcctataatcccagcactttgggaggtcgaagcaggaggactccttgagcctaggggtttgagaccagcctgggcaacatcacaagaactcctctctacaaaaaattttgaaatgagctgggcatggtagtgtgtacccataatcccagctactcaggaggctgaggtgggaagattgcttaaacctgagaggtcaaggctgcagtgagctatgattataccactgcatgccagcctggaccacagagcaagaccctgtctctaaaacacaattaaaacaaaaatttcagttgaatatgttcctaagaagccacaaaagagtcttttgttatgattcttaaatgaaaattaactaaaaattggaaataaggaagaatgtcttttccatgtcatactgaggcactgcttaatgacctgcccacggatgattaattatcttggagagagtacatgtatctgactttgttatttattatttgattagagcactgacatagtgaaattacacgttaacttgtagatttctgtccagtagaaaaaagacgacattaaaggttatggttttattgcccttatagcatgttaaccagatttctctcgaatttagcaatcttatgctaaggttttcattaaagatgctgatgagtccactttttaaatgcccttggagcgagctttaccattttactggttccctcattaatgggttaaataaattttttgacaagtgttcattccacatttgtatgagtcacattttaaattttgaaaatatacttcagcatgatcttaataatgccaagtcccagagagttctctgtgcccataatttagttcactgggcacattcccagagcacgttcagtatgcaaagcatcatggtgggccccgcagggaagactaaaatgggtaggactggtccctatagttgcagatttagtaattacttatgggcagaaaagaagtatataaattacttcctacactgtgagaaagagaaaagctgcccctggcagccgggagctggcttgacactcacagcttggccaaagtgttctcctgttgaatgtaaacaattttgcagattgccggcatcagacaaggccatcctgagaccgtgatagatcaagacaaaataacactactcctgaaggcagataaagacatgaacattgtcccagccacaaaaatcacccaatagccccatttcctagctcatatgagtgactgctagttctccatcaatcacagtttcagtcttactctgttcttctccctttaaaggaaagaattaggaagacactctatcagagaattacctccacttcctgacaacatccaatccagagtaaatgctcacttcctttaaactgtcccccaaagcacctaacacaagcccaaattttcttttcttttctttttctttttttttgagacggagtctcgctctatcacccaggctggagtgcagtggtgcaatctcggctcactgcaacctctgccccccgggttcaagcaattctcccgcctcagcctcccgagtagctgggattataggcacccgccaccacgcctgactaacttttgtatttttagtagagacggggtttcaccatgttggccaggctggtctcgaactcctgacctcaagtgatccacctgcctcggcctcccaaagtgctaggattacaggtgtgagccaccacacctggccccaaattttctaataagtgctttctaacaccctcttactgatatctgcccacagctgattaggtgcaagctagcccagtaccaatcgatagaagacagtacagactcactaaagtgatatatgatggagaaaattgtccccatccagacttcccttagagagaagacccggtgtggttggtgggaacactctgacgcttcttttggttagggttgttggccacaagcaacagaaatcaactctgcctgactcaaccaaaaaatgggattgtagaaggctatgagtggggatgggggctcaggagtcggaaggacaggcttggaaatgagtatggatcaagaaagccccagagactggccacaggaccaatctggccaggaagccgccattgctggacagcacaagtctaatccctccatccttttatctctgtcatttgctctgtggtcaaagtcttggacatgagcttctgattggctgagtctgaggaagtgggggtgctcccttgttgaacttctctaataatgactgacacagtgaatgctttccctaaaactagggtttggaggttgagcagccaaaaattccaacttttttccattacaggagggagacacaaccccacccaagaccatgtgtaagtaacaataggtagtctgtaaacagccttccatggccaggaatggtggccaaagaaggtcttctttgacagaggtcaaagaagagggtgggggccaggcacaggggctcacgcctgtaatcccaacaatttgggaagccgagatgggaggattgctttgaggccagaagtttgagaccagactgggcaacatggtggaaccccctctctataaaaaatataaaaattagccaagcatgctagggcacgcctgtatttccagccactcaggaggctgaggcaggaggatgtcttgagcctgggagattgaggctgtggtgagccatgatcaagcaactgcactccagcctacatgacagagcaagaccctgtttccctgtcacaaacaaacaaacaacaaacaaaaacacatacacataaaccccgtcgttctaagcaaagtgagtcctgctatctgcaggattttgatttttttccaagagcattatgctgaactggtatcagaattaaattgcttggaacaattgttcctggatcaaactgagggttgggctgcttattctagtgacccaataacgagatgcaaataaactgggaaaggagggagtttctatttctgttaccagttacagggaaaaagcctggaaaataccaccagaccaactcaaaattacaaagtttcccagagcttacataccttctaaactatatgtccacgtgtaagtgtgcgttcacctaaagacctaaataatcagcttcttctagtctaactaaggtctgagtcctgaagaccttcctctgaagcctcagtaaatttacttaatctaaatgggtccagttgctggggtgattacccttatcttgtctcctgctaaatcatggaggtttggggacttccttcacactcccaataaacttgtttgtggaggcctggggagtttcttcacacccccaataaaacttgtttaatcctaaacgtgtcctgttaagaattgcctcgttatctcgtcatgtttcaaggcccaggaaaggcctgagcaaaactgttggaggatttctgttacattccagcctttgtataagggcactggctcttttagctttttttttttttttttgagacagagtctcgctctgtcgcccaggctggagtgcagtggtgcgatctctgctcactacaacctctgcctcctaggttcaagcgattctcctgcctcagcttccgagtagctgggattacaggcatgcgccaccatgcccagctaatttttgtattttttgtagagacatgatttcactatgttggccaggctggtcttaaactcctgacatcaggtgattcacccgcctctgccttctaaagtgctgggattgtacaggcatgagccaccatgcccagtaggctccttcagctttgtttttttcttcttcttttttttttttttagtgacagagttttgctcttgtcgcccaggctggagtgcaatggcaggatctcggctcactgcaacctccgcctcccaggttcaagcgattctcctgctgcagcctcccaaagtagctaggattacaggtgcctgccaccacgcccagctaattttttttgtatttttaggtgagacggggtttcaccatgttggccaggctggtcttgaactcctgaacaaggtgatgcatccgccttgggctcccaaagtgctgggattacaggcatgagtcactgcctgcccagccactttcagcttttaatgtttaacttaaccacacagtccctgctgaaatagctgtcatggaggcctgcgttagtgagacctgacctgccacacaatgaaggagatgttcttcattgagataatgtgggtgtccgaatcaggatccacaggtcagtgtcccagctccaccattgactagctgtgtgattccgatggagccacttaacctctctgagctgtgggatcttcctgtataaaagagacaaccacgtagtgcccacctcaaacagtggttatcaggattgagatgatctgtgtaaagcatttagtgcctatgaagcacttcttagtgtataaagcacttagggtgtaaaaggtgcatggtaaattctgtttgtcgcccgggctggagcgcagtggcatgatcttggttcactgcaacttctgcctcccaagttcaagtgattctcctgcctcagcctcccgagtagctgggattacagctgtgcaccaccatgcctggctaatttttgtatttttagtagagacgggatttcaccaggttggccaggctggtcttgaacccctgatctcaagtgatctgctggtcttggcctttcaaagtgctgggattacaggtgtaagccactgcacccgccctgtgcgtggtgaattccgagtaaatggtagccaaaatcattgtcatcatcatcgccacaggtaaccttttccccaaataatactcagcttctcttctaagtaaacgttgaatgaatactttagagtgttgaagaagcacccctaaatctgcccacttgttgattctagccagtgatgttaaatttttaggaatctggagaaccagttgttcaactgtgggtagctcaaaatctgcagcagtgggagtatttacaccgtggaaattggcaaatgattcacagcaaggcttctacctccctcccctgcttccagccagttaaacattccccagcacatcactcattctagtcctagcctgccctactttggggcatccaacagagattacttgcgttttctttgtggtttatcaagccccagggtctcgcttgcctacaaaggagaccactaatcactagcatgctgaataaacatgaagttgacttaaacattaatttacttattatcaaaagcttatctgcttctgctggtgcaatgactctgatgggaattgccagtggtgatggtagataggtgatggcttcagagaagtgtgctctgtgctttggcaggagcagggctaagctgagacagtggtcctagtggcccagtccatgggctaagcaggaatgggtgggaagagggcaggggaggcttccccggggcctgcagattgtgttcttaagagttttttccttcagtccttagaagctcagctgaaaggaatgactgcggccggatgtggtggttcatgcctgtaatcccagcacttagggaggccgaggtgggcagatcacctgaggtcaggagtttgagaccagcctggccaaactggtaaaaccccaactctactaaaaatacaaaaattagctgagcatggtggctggtgcctgtaatcccagctacttgggaggctgagccagaggaattgcttgaacccaggaggtggaggttgcagtaagcccagatcaagatcacaccactgcattccagcctgggcaacagagcaagcaagattctatctcaaaaaaaaaaaaaaaaaaaatggagtgattgctttaaaattcttaaacagggccgggtgcggtggctcacgcctgtaatcccagcactttgggaggcagaggcaggcggatcactaggtcaagagatggagtccatcctggccaacgtggtgaaaccctgtctctactaaaaatacaaatattagctgggcgtggtggcgggcgcctgtagtcccagctactcaggaggctgaggcaggagaattccttgaacccaggaggcggaggttgcagtgagctgagatcacgccactgcactccatcctggcgacagagtgagacattgtctaaaaaaaaaaaaaaaaattcctaaacaggaggggcttagggccagccagttggtcacatgaaacaatcaggggacttaccttagagctgccttcgcagtagggagtccatggtttttagtgagatttgtgtcgtacaaattaattaaaattgcatagtttctatcaagtttttttcttacactttccacaaaattgggaaaaatgtctatttcccatttctttatttcattttctcttattgcttctatcctacctgatatttcccatttcaaaagcacgtttttttttttgagatgcagtcttgctctgtcgcccaggctggagtgcagtggtgccatctcggctcactgcaagctccacctcccgggttcacgccatgctcctgcctcagcttcccgagtagctgggactacaagcacctaccaccattttttgtgttttttagtagagacagggtttcactgtgttagccaggatggtctctatctcctgacctcgtgatccaccccgcctcggcctcccgaagtgctgggattacaggtgtgagccaccgcgcccggcccaaaagcactttttaaatgttgaggtggtttgaaggctaatggaaattacgaggtgggactgaaaccattccctgccatccctaagaaagcccactccttggaactgccactggtgaaagtctcactctgtcacccaggccagagtgcagtggcacaatctcagctcactgcaacctctgcctcccaggttcaagcgatcctcccacctcagccccgcaagttgctgggactacaggtgcccaccaccatgcctggctaatttttttttttttttttaagtagagacggggtttcaccgtattgcccaggctgatctcaaactcctgagctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcaccgcctttgatagatgcgattgccctcgtggtgtctatcatgagacttgaaatttttccacctgcacctgcagtctttaggccttgtttcaacaaaatgcagtactgtgtgtaccctccatgcctgccagccttccttccttccttgtgtatttactgcaatgtatcagggacggggtggtgtgctagaaccatgaaggaaaaaggcaaagtcccttaaaggaggtgcagtctgttgaggcagaaacacaaatgcctagatggttctggaatgcctagatgtcaatgggataacaagggggctatggctgcaggaaggaagaggacctgatgtagctgagggcatcaggaagattccagaaggagaagggattagtgaagctgcagagcacttagtttgagacaaagatttctgagctgagggaggagttgggcaaaggcttgagtgcaggagttcaagagaactccttggggccaggctttacacagggatgcacatgggctgtgtaccagtctgttctgacactgctgtaaagatactacccgagactgggtcatttataaaggaaagaagtttaattgactcacagttctgcatggctggggaggcctcaggaaacttgcagtcatggcagacggcgaagggaaagcaagcacgtcttacgtggcggcaggagagagacagcacaagagaaaatgagtgtaggaagtgccacatttaaaaccagcagctctcttgaactcctgcactcaagcgatcctcctgcctcggcctcccttagttctgggataacaggcaggagctgctgtgcccacctggagcttaatctctgttcacatctttaattattctgggccagcttagccaaaggccttaggggtagggttagggacaccaagggccagtcttctatccacttcacagctcgctgggccctccaagggaaggactatgtgtctcattctaggcactggtaagagtctgggggaaaaaaaatcaaaaataacaagtggacgcggtggctcacacctgtaatcccagcactttgggaggccgaggtgggtggatcacttgaggtcaggagttcaagaccagcctcgtcaacatggtgaaaccccgtctctactgaaaatacaaaaattagcagggtatggtggtgtgcccctgtaatcccagctactcaggaggctgaggcacgaggattgcttgaacctgggaggcagaggttgcagtgagctgagattgcaccactgcactccggcctgggcgacagaacgagactccatctcaaaaaaaaaaagaagaagaagaagaagaaatgaactcacaacacttactgtctccttcaaaggagtgaaggatgtgcagagggctaagtgcggtcccagaaactgccaggtagcatcagtgagcaggtgcaggaaatctgttggccaaccttgcatgcactgggcacggcccagttccctgccagagcccagagaagaaaacaagctctggtctcagtcgaagcagtggggtgggaagagccctgctgtctcgccacatggccttggtagctggcctatgtctcaatgtctcttgaaagtgaaaatagatcaggagggctgacacgtagtaggcgctcaagaactgttttctggatgagtcagtgaattggtgaacagcattcacctctctgggcattgatttcttcattcatgtaaggtgagagctcttctagctgcagaaatttctttagagccaggcacagtggctcacccctgttatctcagtactttgggaggccaaggcaggagaatggcttcagcccaggagtttgagaccagcctgagcaacatagtgagacccccatctctaccagacattttttttgagatggagtctcactctgttgcccaggctggagttcagtggtacgatctcagctcactgaaacctccatctcccaggttcaagcaattctcctgcctcggcttcccgagtaactgggatcacaggcatgcaccaccatgcccggctagtttttgtatttttagtagagatggagtttcgccatgttggctaggctggtcttgaactcgtgacctgaattgatccacctgcctcggcctcccgaagtgctgtgactacaggcatgagccaccgtgcctggcccaaaacgtttttttaaaattaccaaggcgtggtggcatgcgcctgtagtcccaactacttggaaggctgaggcaggaggattgctctagccaggaggtcaaggctgcagtgagctatgattacactcctgtaagttcagcaaaatatttctgtaaagggccaagtactaaacaccttaggctctacagagtgtacagtctctgtcgtgattactcacctctgccactgtcgggaaaaacagccacagacaatgctgaaatgaatggacatgacttcgttccaatagcatgttattcacagatgctgaactttgaatttcatataattttcatttatcagaaaatgttatgattttgattttccccaagtatttaaaaatgaaaattaaactattcttagttcgtgagttgtaccaaaacaggcagtgggccagattttgactgtgggctatagtttgccaaccccagctaaagattgaggagcaaacgcatcttccaggaattccttggatcgtcttagacagaaggtcaaagggagagtgcactctctccttggtgtggaaatactgatcaccatgtcttccaaactgggtttcatagacacatctccatgccatgctctcactctagaacctaagatggctcccatgttaaggttctttacaacgcagacacatatgtccctgatatgtcctaattgggcagactcttcattgtcacctaccctggcataccacacccattcctaatatttgtctcagctcccccttctctctgagtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgtttgatgtttttatagtgagaccatatttatgtaatatttgtataattttttaaatagaccaagctgggtgtggtggtatatgcctgtgttcccagctacttgggaggctgaagcaggaggatcccttaagcccaggagttcaagtccagcctgggcaatatagtaagaccctgcctctaaaaaagaaaaaaaaaaggaccaagtattcttttttttttctttttttttttagatggtgtctcgctctgtcgcccatgctgcagtgcagtggcatgatctcagcgcactgcaagctccacctcccaggttcacgccattctcctgcctcagcctcccaagtagctgggactacaggtgcccgccaccacgcccggctgattttttgtattttcagtagagacagggtttcaccgtgttagccaggatggtctcgatctcctgaccttgtgatccgcccgcctcggcctcccaaagtgctgggattacagacttgagccaccgtgcccggccaggagcaagtattcttttaggtctaaaacaaaggtaactaagcaatactggtgtttgtttgttttgagacagggtctcactctgtcaaggcagacagctggaaacccacgtcaagaaaattgactattttcaaaagtcaatccttgcctcccaggttggagtacagtggtgtgatcatggctcacccaggagctcaacctcctgggctgaagtgatcctcctacctcagcctctctggtagctggaaccacaggtacacaccaccaggcatagctaatttttttattgtgtagagacagagtctcgctatgttgcctaggctaatctcgaactcctggactctatcgatcctcccatctcagcctcaaagtactgggattacaggcatgagccactgtgcctggccataatttttttatatcatacatacagaaaagagcagtattagtagttgttattgtaagaaaaatgaaaactaaggcagtctagaaagcccttggaagagagaagaataaactgcgcttgaggaagttgacatttgggaacagagtgggaacaagggtcttgaagaaggtgacatttgtttgggaacgagtgtctgactgcaatcaaaggaaaggccagtgtgacaggtggatgtaaatccacagtccattaaaatggccacagagagaaaacagacatattggccttccagggtgcaacatgagggcattcccttcctatgtacactggcaggcacctctccggtcccttggtccccagcaagatgctgagaaattgctgaggccaggggctccctggacacttatcaacacttatccttacccagggatagcgtttaagctcatgaatcctacgaaagctgaaccaatgcacatgtttatcatcttggaaccatttgatttgaggaaattgtaatagcacatgctggccaggcgcggtggctcatgcctgtaatcccagcactttgggaagctgaggcgggtggatcacctgaggtcaggagttcgagaccagcctggccaacatagtgaaatcccctctctaccaaaatacaaaaatttgctgggcatggtggcaagtgcctgttatctcagctacttgggaggctgaggcaggagaatcgcctgaacctgggaggtgaggttgcagtgagccaagatcccgccattgcactacagcctggacgacaagagcgaaactccatctcaaaaaaaaaaaaaatagcatgtgatagtgagatacacattttgcacagaaatgttggctgagatagtccaggagagtctctgtgagctgactttttacctagggtggaggagtggatggaagtggctgttcctacacacccacactgcctgtgcaaaaccgtgggctgcctgcaccacacacacaagcctgtttgattctcatacaaccccaagacaaaggtgtaatcccttttcaacagtgacagcactgaggctgagagcagcaaagtaggtcatagccagtcaatgggggtactgagatctgcattgagatctggctgtgtctaaagcgggttgtatcctctctgtgcttgcagaatggggctcgagggctcatctaaacccctcatcttatttatttatttttatttatttatttatttattgagacggagtctcgctctgttgccaggctggagtgcagtggtgcaatctcggctcactgcaacctccacctcccaggttcaagtgattctcctgcctcagcctcctgagtagctaggactacaagcacgtgccaccacgcccagctaatttttgtatttttagtagagacagggtttcaccatgttggccaggctggtctcgatttcttgacctcgtgatccgccctcctcggcctcccaaagtgctgggattacaggcgtgagccaccgcgcccggcccagacatgacatctttttctcacctgtcttaagatacctgcagcctctgtaacttatttttaaaaggagacaataaagactatttttaaaagtcaatccttgcctctgaaaacctacctctgcctttgtcgtggtctctgctgggtttccattaggctgcaactcaagctgctgatgcctccatttcatgtcgttttcacaaacattttgtaaagcagcagctctattattccagcagggcctgatcacctctccgcacccaacgctgataaaaatgacccgctttcccctatcgtcccagcgtgaaagaccaagatgctgaatgacacgggttggctttcttttccttccgaacattaatcaggttcttgaagataacatctctctctggaacgagccggcagcagcagagtttgatttccaggttcagccctaatggtacagagacctggactaatgtggcttattcaaagttccagccatgcttctaaagcatggcttattcgaacttccagctatgcttttaaagcactttgcatgaactattcacatgtcttttgaacaatatgatttaatggcattggaaaatcatcatgatgtcatgcttgcaatgagcaggacagctgtatgtcttgatccaatacacattaaaaatgcacctatccacacatatgtatctgtgaaaatgtcttcagctgcaagtaacacagcgtccgacgactagtgtcttaaatcttgggtgaccagctgtctctgtttgcctgggactgagaggtttccaaggatctggaaactgcagtgcagaaactgggacagccccaggcaaaccaagtcagttgttcacactacttaagtcataaggacatttaatatttacttgaggctggacacagtggctcacacctgtaatcccaacactttcggaggctgaggcaggtggatcacgaggtaaggagttcaagaccagcctggccaagatggtgaaactccatctctcctaaaaatacaaaaattagccaggcttggtggtggatgcctgtaatcccagctactcgggaagctgaggcagagaatggcttcaacctgtgaggcggaggttgcagtgagccgagatcatgccactgcactccagcctgggcaacagagctagactccgtctcaaaaaaaaaaattttttttgacttgataagcagtccagatgcaggtggcccgagggtcagtggggtggccccaggatgctatcaagggtctggctgtttcctttcctcccctctgccctagatagcgaacctgtccccttctgcccatgggtagtaagccaatcgctgttatgatggatttggcaaaagaaaagaatttattcacaccaacgcagccaagcaaggaggcaggagaaaaggtctcatacttgcctccctgaagatggaatttagggatctttatggaataaaggagcagggtggtctaaagtgtgggaagaggtgattggaggcaaggaaaagtgaggtcattggcaatctgcacatacatagccaagcttcctggatcttcatagggtgcatgtttagaaaatggcagcattagcatgatctcggggagttttgggccctctgacgtcaaaaggtcacttctccggcatttgcacaggttcagttgaagggtcattgatctcaacgggttcgaactggacaggagctgcccccatagtcctgaaaaacaactttaagcaaccattaccgtagtcacatatgtgtcgtagcgacatatatgtgacatatgacatatatgtaccataatgacatatagtgacatatgtaaggaagccggtgggggggttaggtatatatcatttggctgcttgacttttagctatataagttttaagaccagctagaagtaagtggttaaaagcaagcaaggcaagttaagtttggtgggcttcatcaggttagcgttcggtttcgccattctcacgtgagtggctgtaggagcttaggaccaggacaggggagaaccgaaggccctaattatccttcccagaagcctgcccaagcggagtttctcttaagggctttctctaagcccaccaaacttaacttgccttgcttgcttttaaccacttacttctagctgatcttaaaacttatatagctaaaagtcaagcagccaaatgatatttaactaaaccctccactggcttccttatatatgtcactatatgtcattatgttacatatatgtcatatgtcacctatatggcactatgacacatacgtgactatggtaatggttgcttaaagttgttctcttacatttcattggcccagagtagatgtcatagctacctccacttgcaagagagcctggaaaagtatgtgtctagccaaagcaaatgggattctgtgactggcttccatcaaggcagggcaggttgcctcctggacaaatcagagctctgggagaaagcgggaggggaaggtctacaaccagtcatgcccgctgcaactcatggagccacatggagaggagacaacacggtgaaattgtcaagagcaggagctagggctgaatctggaaggccacttaccagtgcagagctttgggtgtgttgcttaacctccatgtactcatctgtaaaatagagctaaaaacaatgtttctcttcctggactgctgtgacggtctagaagagtttatgcacagaaagtgcatttacatgtaaatgctccgtaaatgctgacttcttgtttgccttaatggcagaacccatccttccatattccagaaaaagacttgatttttagttacgtgaatggacacctaaccctgatggacagcttggggtcgggggacaagcttctttcttggaaggatgttcaaaggaccatgaagcttttggttttgccaactggggtttgtaagttgaagaacagagctgagtaattcaggacaggggtgtccaatcttttgtcttccctgggccacattggaagaattgtcttggaccacacataaaatacacttatagtaacaatagctgatgagcttaaaaaaaaaatcacacacaaaaaaaatctcatgttttaaaaaggtttacaaatttgtgttgggctgccttcaaaagccatcctgggcctaatttggacaagcttgatttaggacctgatggtcctcctttagcggaaggtgtgtggaggaggtagagagagagagagaagagatgagacatgaggaaaacagagccatctcatagggacgttgatggagtcctgcagcgtgaatcccgtcagcagttctgtagagctccacctcgcttgtcaatgggttgtgggcttggatcttttgggaggattcaatgacatgctaagggcagccttggaggtggacaaagggccagggcaaaggcccccagggcatgcccgccacccttaggttacatggaggaaaaagattgctgtgaaatacaccagaaccctcggagtagaagtggcctctgctacacgtaggtcaaggttctgcatactttcatcttccttctttgtacttgtttgtattttccaaaatttctacaatgattagggatccattctataatcagataaaattgccatttacaaacttttattggccaggcatagtggctcatgcctgtaatcccagcactttgggaggctgaggtgggtggattgcttgagtccaggagtttgagaccagcctgggcaacatggcaaaaccccttctctaccaaaaatacaaaaaattctccaggtgtggtggcgcctccctgtagtcccagctactctggaggctgaggagggaggatggcttgagcccaggaggcagagattgcagtgagctgagattgtgccactgcattccagcctgggtgacagagccagactccatctcaaaataaaataaaataaaataaataaataaaaataaaaacttttacaaagaagagtataagcactgaaagttatttttaaaaaggttttacttgttagctccattcctcagaaatagtgcttcttccacatcattttctctttccttttttctctgctgcttttttttttttttttttttttgagacggagtctcgctctgttgccaggctggagtgcagtggcacgatctcagctcaccgcaatctctgcctcctgggttcaagtattctcctgcctcagcttcctgagtagctgggattacaggcgcccactaccaaccatgcccggctaatttttgtatttttagtagagacaggatttcaccaagttggccaggatggtcttgatctcttgaccttgtgacctgcccacctcagccttccaaactgctaggattacaggtgtgagccaccacgccggccattttttttttttttttttttttttttttgggagaaggagtctcactctgttggccaggctggagtgcagtggcatgatcttgactcactgcaacctctgcctcctgggttcaagcgattctcctgcttcagcctcctgagaactggggattacaggcatgtgccaccacacctggctaatttttatatttttagtagagaaagggtctcaccacgttggccaggctggtcttgaactcctgacttcaagtgatccttccacctcggcctcccaaagtgctgggattacaggtgtgagccaccccacccagccattctctgcttctttctcacagctaatgataataatagtaaaggccaagggtggtggctcatgcctgtaatcccagtgctttgggaggctgacatgggaggatcgcttgaggctaggagttctagaccatcttggccaacatggcaagattctgtctctacaaaaaatttaaaaattagctgagtgtaggggcatatgcctaaagtcctagctacttggaaggctgaggcaggcaaatccttttacccctggcgttcgaagctgcagtgagctatgattgcactgctgaactccagcctgggtgatagagctagaccctgtctctaaaaaacataataatagtagatagcatttactgggcatttgactgtgtaggtcccaggcactgtgcttaatgcttgatgtgcataataatcccagcaaatagtactgccattattcctatttaaaacatgacggctaggtgcggtggctcacgcctatcatcccagcactttgggaagctgaggcaggtggatcacctgagatcaggtgttcgagaccagcctgatcaacatggtgaaatctcgtccaaaaaaaaaaaaattagctgggcctggtggtgcatgcctgtaatctcagctacttggaaggcttaggtaggagaatcacttgaacccgggaggcaaaggttgcaatgagccaagatcgcgccattgcactccagcctaggcaacgagagcaaaactctttttcaaaaaaaaaaaaaaaaacataaataaataattaaaaatgagttaggtgagacagaaaaggaagtcactgtaccatggccctttgagccagagttgtttggtgccaaaactctgcctcctaatcactacctgtctctccttttgtcctttctccatcttctcctctcttacctctcaaaaattatcaataatttgataattctgtggttagaatccaagattcctcaacttcagtgtgattgacatggtggctggctcactttctgttgtgggagctgttctgtgcacagtaggatgtttagcagtgtccctggtctctacccactagatgccagtagcaaccacacccctccccaacacacactcaattataataaccaaatatgtctccaggcattgccaaatgttcctggggaccaagattgccctgatgtagcctgatctctgcaaaagcgtctggagtctctccagttgaacgatcgctgatagaaactcacgggaacagtctgtgccctcccggcaagtccacgctcattcgaggcagctgtcacctgctaggacattccagggcacgacttgaaaaatgcttggcgtgcctctgacaacaagagatgcaggctgaagcaaggcattcctgcctcttgtcctgaaactgggatgctggcattagaatggacagcatgagttgttcttgagtggcaaaaggcaaggggtcctgctgtggtttgtatgtctgtctcctccaaatctcatgttgaaattagtctgttctcgcatttctataaagaactacctgaggccgggcgcagtggctcacgcctgtaatcccagcactttgggaggctgaagtgggtggattgcttgagccaaggagttggcaaccagcttgggcaacatggtgtaactctatctctattataaagaaacaaaaaaatttttttttgggacggagactcgctctgttgcccagtgcagtggcgcaatcttggcccgctgcaacctccgcctcctgggttcacacattctcctgcctcagcctcccgagtagctgggactacaggtgcctaccaccacgcccggctaatttttcgtatttttagtagagacggggtttcaccatgttagacaggatggtctcgatctcctgacctcgtgatctgcccacctcggcctcccaaagtgctgggattacaggtatgagccaccgtgcccagccagaaaaaaaaatttttaaacaggctacctcagattgggtaatttatacagaaaagaagtttaattgacttgcagttccactggctgtacaggaagcatggctggggaggcctcaggaaacttacaatcatgatggaaggcgaaggggaagtcttacgtggctggagaaggaacaagagagcaaagagggaggtgctacacacacttaaacaaccagatctcgtgagaactcactatcatgagaacagcaagggagacgtccacccccatgatccaatcacctccccccaggcccctcctccaacactggggattatgatttgacatgagatgtgggcagggacacagatccaaactacatcataggccccagtgggaggtgtttgggtcacgggggtggatcccccatgaatagattaagctcttcctgggaggtgggggtgagtgagttctcactcttttagttcctggacagctggttgttaaaaaaagcctggcacctccccctctctcttgcttccactcttgccctgtgacttctgcacacatgagctccctttcaccttctatgaatgtagccagcctgaggcccatgccaaatgtcccatcttccagccagcagaatcatgagccaaataaacctcttgtctttataaagatattatttcctcttcattaaagaacagcttttctaaatgttgggggaaatgtccatagtcattactcaatcaaaacttgtgttcccataagcctaaggaccattctagattttttacatgtttttttgtgtgtgtgtatctataaaatgcatacataaatttttttttgtttttaagcattcacccaaacaaaaaatcacaggtaaacccatatttctgagatgccattattccgagctaaataagagataatcacttcaaggtaaattgaaaattttcctgaagccatacatttcaagtgaaataagtaattctaaataggacaatttaaattggataattttaaagcgtctataattggtttatttgcaaaattcctgaaaggaaaaattttatcactgccatcacagcaggtttccacatccagatgagaaaacaagacaaatgctagtgtgttttaactagctaaacaaaactaagttaaatgaatatttaaaaatttccctagtgggccattccttaacaaaatgttgaaatccctgttgctacattgactaaaagatcatgttgaatggaatatgtaagacttggctcatagaaacctaatcagatggttagagatgctggcagtttaggacctgctgccataaatgtgtgaacaaccttttgtaatctaacctactgacctgcatgttttttctttaccccagctcattccttacatgtagcctcaatcttcagtttgctttactggttcagcaaaagccaggaagaacaactttgtagtaatcagaatgttatccaactgtatattgtttactttatcgtaaatactggtgaacagtggttaataaatagttttatattcctttatgcaaaaaaaaaaaaaagcactcagccacaggcattccttgatagcaacactcaggggactaagatagggccccatgctggtatacagatggcactgctgaaaggagtcagcagccccggcccttgatggagacgctgaggaacgaggcagaaagatcagtggactcagactccgaagggtcgatttctagttctggtcctgcccccatgagctgtgtgtactcagttgagcctctttacctgtttccgcatgagtaaaatgaaaatatgatttctgtcctctggtttttcctaggatagttgtcaggagcaaagtaagatactggctccaagctgacccactacatcccttacctgcttcagtcttctttgtaacatctgaaatattgtatttgggtttaccttctgtctctgctagcaaaatgtcatcttcctgagggcttggtcttctttgctgttgcaagcctcagagatgacaacaatgcccaacatagtagatgttcaataaagacgtgcaggccaggtacagtggctcacgcctgtaatcccagcactttggaaggccaaggcgggaggatcacttgaggccaggagttcaagaccaacctggtaaacagcaagaccccatctctatgaaaattttaaaaattaaaaaaagtatgagctgggcatgatggctgcacagctgtagtgccagctacttcagaggctgaggtgggaagatcacttgagcccaggagttcagggctgcaatgagctatgactgtgccttgggtgatacagcaggaccctgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaacatggagaagaagccttagaggaactgatgttcatcctgcagtggccaaaattgctcaaacctgaaaagccagccttagtaatcaagatgagggtgtaattagcacaatcccgatgaatctcatttgtgaaattgcagacagccattacaaatattgtttacagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggccacactgttggtaatgtcacacatgatctctccggagggcaatttggaaattcctactacaatgtaagtgttcatgccactagacccagcaattgcatttctatgaatctatcctagaaatgtattaggaaacaacccagatgtctatgaataggggaatagttaaataaattatagttaaatagatcactgtataatcagctgagtgcagtggctcacgcctgtaatcccagctactagctactctggaggctgaagccagagaatcacttgaacctgggaggcagaggttgcggtgagccaagatcacaccactgcactccagcctgggtgatacagtgagactgtctaaaaaaaataaaaataaaaataaatttaaaaaataaaaatagatgactgtatatcaatataatggtatactatgcagccactaaatatgtggagatttgcatatactgatatggaaagatgatcaagactattaaagattattaaattgaaaaaagcaaattgcaaaaaatttttgtgcaataacaatggtgtcatatatgatattataagcatacgctttttttttaaatctggaggaggctgggtgcagtggctcatacctatatcccagcactttgagaggctgaggtgggaggattgcttgaagccaggaatccaagaccagccgggcaacataacgaggtccctctctctacaaaaaactgtttaaaaattagcctgtagtcccagctactccgtagggggctggggttgggaggggttgtgcagaggtgggaggatcccttgagcccaggagttcaagtctgcagtaagctatgatcacgccactgcactccatcctgggcaacagagcgacactctatctccaaaaataaaaaataaaaaattaaacattttcaaaataaaaatgtttttaaaaaatccagaggaatacatactaaaccgttgacaatgattctctccgaaggacagagggagactttcctctatgttgtgaatttctgcagtgtttaaaaaacgtaaactttagctgaaaaacgaaactgaatatgccatatgaacccacttatataagcaaacctaagtcaggcacatgaagactggaaggagctctatcgaggtgttattaacagtgactgatggccaggcaccgcggcttatgcctgtaatcccagcactttgggaggctgaggtgtgcagatcacttgaggccaggagtttaagaccagcctggccaccatggtgaaaccctgtctctactaaaaatactactaaaaatacaaaaaaagttagctgggcatggtggcaggcacctataatcccagttacttgggaggctgaggcaggagaatcgcttgaacccggaaggtggaggttgcggtgagccgagatcatgccactgcactccagcctgggcaacagagtgagactctgtcacaaacaaacaaacaaacaaaaaacagtgatcatttctaggtggtgggataattgagcagtgtttggctttttccttttgagggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatggacttgaagcaggagctgcagaacttggtcgccatcccaggtaaccatttgcaacttcaccttgtgctaaacaggtgcttgggggcccccagcctggcccatctgtacgcctgggtctggaagacagagcctcattcttgcaatgcagtgctccctgactgcatgtgtcaaacacaacttcgagtcaggaagacctgggttcaagtcctagtgaattctggtcaccttcttgtccttggacaagtcactgtacttctctgagactcaatttctcctcctctgaaaattggctagtaatagtaagagggtctaattcattgagtataaatatcctaaagaggctgggcacggtggctaatgcctgtaatcccagcactttaggaggctgagatgggtggcttacttgaggtcaggagtttgaggccagcctggccaacatggcaaaaccccatctctactaaaaatacaaaaattagccaggtgtggtggcacacacctgtaatcccaggtaaccggcaggctgaggcaggagaatcacttgagcttgggaggtggaggttgcagtgagctgagattgtgccattgcactccagcctgggcaacacagcgagacactgtctcaaaaaaatatataattaaattaaattaaatatcataaaaatcgatgagatgatgcaaactaagtgcttagcttgatatttggcctcaagagtccagtaaatattagcaattatgaccattattatcctacttgggaacagatgaagtgtgtacaaactctaactttgaagtcaccccagatttggtagttaataatgcctgacttatttggcatcttctccaaaaaattttcccctgcccatcaggctgtgttagttgccctctgtggggcttacccttatcaaaatgctagtcccaggccaggcatggtggctcacgcctgtaatcccagcagtttaggaggctgagagggcagatcacttgagttcaggagtttgagaacagcctggcaaacatggtgaaaccccatctctagtaaaaatatgaaaattagccaggggtggtggcgggtgcctgtaattccagctactcaggaggctgaggtgggagaattgcttgaacccaggaggtggaggttgcagtgaggtgagatctcaccactgcacttcagcctgggtgacagagcgagactccgactcaaaaaaaagaaagagagaactgagtaatttataaagaaaataagtttaattggctcacagtcctgcaggctgtaccagaagcatgatgctggtgtctgctcagctgctggaaggcctcaggaaacttataatcatggcggaagacaagggagcagacatgtcacgtgcccagagcaggagcaagagagtgaggcgggaggtgccacacacttttaaaagaccaaatctcatgagaactcactatcacaaggacagtaccaaggaggatggggctaaaccatcatgagaaacctccatcatgatccaatcacctctcatcaggccacgcctccaacactgggtattacatttcaatatgagatttgggcggggacacacatccaaactatatcagaatggatgctgctgattggttggggatgcaatcataggtgtgtgaaaaatgattctcaggggtgctaagtccacttctgggtggcaggtccacgtggatcatcattcatcagaaatgcaaaacctaaagagatatctcaaaaggctgatcttagattctgcaatagtgatgttatctgcaggagtaattggggaagttgcaaatcttgtgacctctggaataatggcagtagtcatttatgtctacaccttagcagaattcagcctcctcccatccttctaacatgggggccttttattagctttacaaaggcagtttagttggtggaaaaggttataatcatttaaactataaactaaatgtctcccaaagctagcatggcctaaacctgggaatgattaagggcagcttggaggttaaaggcaagatgggggttggttagatcagatccctttcactgtcctaattttctcactgttatcatttttgcaaaggtgttttcaaataggccagataagcacccaccattacccttgacttgaatgtttttgccatgctgtcagttcaataactatgtcccaagaggctgttctgcagcaagctctgaacctaggagccgggcttgcagtgatgaacagagaacggttctccactctcaaggagcccccaggttagcagaaagagactgggcccagcacacagtgggtgcccataagtggcagttcttactgagctacaagtgcagcatgatgagccttaaagcagcgtttcccaaccttcaactattgacatttggggttgacaaatgtcagtatcttcctttggggttgatcattttttgttgggggtacggggctctgtgttgtgtcttgtgggatgttgagtttcatccctggcctctacccactacaggccattagcacaacgtacctctccgctacccctcaatggtgatgttacctgaaagggatcctgatccagaccccaaagttcttggaccaagagcaagaaagaatttagggcgagtccgtaaagtgaaagcaagtttattaagaaagcaaaggaataaaagaatggctactctgtaggcagggtagcagcttgggctcctcgattgattgtacttatagctatttcttgattatatgctaaacaaggggtagattattcatgagttttctgggaaaggggtgggcaattcccacaactgagggttcctcccctttttagaccatgtagggtaacttcctgatgttgccatgacatttgtaaactgtcatggcactgatgggagtacctcttagcatgctaataccttataattagcatataatgagtagtgaggacgaccagaggtcactttcatcgccatcttggctttggtgggttttggcagccttctttactaatgctgttttatcaggaaggtctttgtgacctgtatcttgtgccgacctcctatctcatcttgtgacttagaatgcctaacctcctgggcattcagcccagtaggtctcagccttattttacccagcccctattcaagatggagtcactgtagttcaaacccttctgacagtgacaaccaaaaatgtctatagatgtacagatgttgctgaatgtaccccaagcgaggtcaggggggtgtgcaacattgccctatgaaaggaaaataaagtcccaggaccccaattcactataccaaaaggaaaagttaagcttgggaactatgagtcatacaaaaacctacttttttttttttttttgagacggagtctcgctctgtcccccaggctggagtgcagtggcgcgatctctgctcacagcaagttccgcctcccgggttcatgcctcagcctcagtctcccgagtagctgggagcctgtaggcacctgccaccacgcccggctaattttttgtatttttagtagaggtggggtttcaccgtgttagccaggatggtctcgatctcctgacctcatgatccacccacctcaagcctcccaaagtgctaggattacaggtgtgagccaccacacccagccaaaactgcctttctttttttcctaaacagatagctgcaagatagaaaggccacctatcttcccaggggcctccctcaccctgtcaatgtaaattaacagcttatcctaacaggtaggggactaagacaagactataaatcatcgtccctccgcccacccggagacaaatgcacatttgacttcctcctctactccgcgtttcctttatcctatgtaaaatgcaaattcactgagggccagagaatgcaatcctccccttcctgccctctctttcccctttaaatattgaagtccttaagatcctctgcagaaaaaagcacaggccggggatcctattgctgcctgtgtctctttttcccaggtgcctcctcgactttggcaaaataaacctccagattgattgagaccttctcagacactttgcagcttacagctcccacataagaactactactttagtaattagagtgcagcaatctgggtttgaattcagccttagcaggcaggtgaacttcgtgaaagttcgcgacttaatttctctgagccttgaattccttgttgggaaaatgaggccaataatactaccccccgcatggttgttgtgaatatcccataaataacaaaggcaaggtgtaggagtcttccacacagtcttgttgtaagggtagtgtgcgcaatgacagtagaactgaatcctctagctttcgtgagcatttactaggtgcccagcactgtgtaggccctaaggataaacgagtgaatagactttcctagttgaaagagagcgacagctagtgggtatggggtttcttctgggggtgattaaaatgttctaaaatggattgtggtgatggttgcacaactctgcaaatacacttggaacagatgaactgcatggtatgtgaatcatattgcaataaagctgttaccaaaaaaagttaaatgtcaaacataaaacaacgaaggaatgagggaaaagtaccaaagtctattctccacccactagaaaccccaatgcaattgatctggcattgttggctttggactctggcattgtaatagaactcaacttgtgatatggtttggctgtgttcccacccaaatctcatcttgaattgtagctcctataatccccgtgtgttgtgggagggacccagtaggagatgattgaatcatgggggacagtttcccccatactattctcatggtagtgaagaagtctcatgagagctgatggttttataaggggtttcccctttcgcttgattctcattttctgtgctgcctgctgccaagtaagacgtgccttttgccttctgccgtgattgtgaggcctccccagccacgtggaactgtgagtccattaaacctctttttctttataaattacccagttgcgggtatgtttttatcagcagcgtgaaaatggactaatacaactagggtctgctttcctggcacagtaagaccagctgtctccccagagtttttgcagtggtaaaaaggaaacagtttatttgcaaggctccaagccaggaggactgggcagctaatgcttcaagcctgacctcctcaatggcttataggtaatgttctgtccaacaggttcaccttgccctctgcctagacaaacctgacttatcaagactggggaattacaatagagaaagagtaattcatgcatagccggctgagggagactggagttttattattcctcaaatcagtgcccctgagcattccaggatcagagtttttaaagacgatttggtggatgggggtgggggtgcagtgagaatggagtgctgattggttgggtcggagatgaaatcacagggagccgaagctgtcctcttgcactgagtcagttcctgggttggggccacaaggtcagatgagccactttatctgggtggtacccactgacccatcaagtgcacggtctgcaaaatacctcaagcattgatcttggtttttacaatagtggtgttatcttcaggagtaatctggggagggtcagcatcttgtagcctccagctgcatgattcctaaaccataattcctaatcttgtgcttaatttgttaagtccattttcacactgctgtcaagaactgcccaagactgggtataacggaaagaggtttcattgactcacagttcggcatagctggggaagcctcaggaaacttacaatcatggtggaaggtcaaggagaagcaaggcactctcttcacaaggtgacaggaaggagaatgaacgcaggaggaactgcccaacccttataaaaccatcagatctcatggaactcactcactatcataattcctaatcttctggttaatttgttaagtccattttcacactgctgtcaagaactgcccaagactgggtataaaggaaagaggtttcattgactcacagttcggcatagctggggaagcctcaggaaacttacaatcatggtggaaggtgaaggagaagcaaggcactctcttcacaaggtgacaggaaggagaatgaacgcaggaggaactgcccaacccttataaaaccatcagatctcatgggaactcgctcactatcacgagaacagcatggggaaactgcctgcgtgattcagtcacctccacctggtctctcctttgacacgtggggatgatggggattataattcaagatgagttttgggtggcgacacaaagcctaaccgtatcacctacaaatgcagtctagttcccaggcaagaagggagtttgttttgggaaaaggctgttatcgtctttgttttaaatgataaagtaagttcctcccatagttagttcagcctatgcccagtaatgaacaaggacagcttggaggttagaagcaagatggagttgattaggtcagatctctttcactgtctcttataattttgcaatggcgatttcagtgcaggtttttaaaggcaggggtaaatttcagtcaagcagaagttacaggcaaaattgtaaatcaatacattgagattacatatcaattttggcctaaaagggctgcatacgttgaagctggggctcacaggtcataggtagattgaaagattttctaatttgcaattggttaaggaagagaagctttgtttaaaaatcgggggtcaaggccaggtgcagtggctcacgcgtataatcccagcaccctgggaggccgaagtgggcagattgcttgaggccaagagttggagaccagcctggccaacatggcgagacccccgtctctactaaaattacaaaaattagccgcgtgtggtggcgcctgcctgtacttccagctactcgggagactgaggcaggagaattgcttgaactcgggagaggggggttgcagtgagccaagattgtgccactgcactccagcctgggcgacaaagcaagactctgcctcaaataaataaataaataaaaataataaaaatcgggggtcagcagaaaagaatggcatccctggcccatgggtgtgactccctccaggcctctctggaagacacttagaacaaggaaagatggtcagaattcagtccttagtcttcctttatctgacgtctatatgccagtggatccatttggtagggtcctgggtttctgaaaaacaactcagacatatatgctaagatgtttatcttcagtttctatagaaaacaaaacatctccagattctaacttccttggctattgttttaggctactattaccttcttactgataagttgcttattgacttttcaaggctagctaggtgcctagaatttcctttgagggaactcaagattttcctttatttccatgcttggggtgggggtctcccacagaccccaaaagggagtccctgtgttactggtggaaggtgtccaggttcttggtgttttgaacaaagaattggacaaaatgcacacacaaacaaaataagcgaggaaagaatgaagcaacaaaagcagaaatttattgaaaatgaaagtacactccatagggtgggagtgtgcctgagcataggggctcaggagccccaatacagaattttctgaggtttaaataccctctagaggtttcccgttggctacttggtgtacaccctatgtaaatgaagtagtggcccacaattagtctgattggtcgcagaaagcttttgcagttgctttctgcgaccaatcagatatactttcaatttctcatgtgacacacagaaaaggaggagggtttgcaaagggagtagcctccagtccttttgttacttatgtgtggaaagttggggtttttcttttgatttagttctaggaagttggccctaggttccctgcctccagaccatattctcctgcctcacctgatccatctcagcattagtaatttttttttttttttttttgagacagagtcttgctctgtcacccaggctggagtgcagtggcgagatctgggttcactgcagtctccgcctccggggttcaagtgaagtgattctcctgcctcagcctcctgagtagctgggactacaggcgcccgccaccatgcccggcaaattttgtttttgtatttttagtagagactgggtttcactgtgttagccaggatggtctcaacctcctgatctcgtgatctgcccgcctcggcctaccaaagtgctggaattacaggtgtgagccaccgcgcctagccgagcattggcaatttttaaagctttgcacctgattgtgataagcagggacggttaggaaccgccaggcctgttcccctctctcatttcacaattctccaaggattagtctggctgaaaggtacagaaacccatccaagcttatgtaagcacaaaacaaacaattactggaaggacagtggagtctcctgaagccctagggcattacattcatttcccagagctgcctaacaaattggtgcaaactggatggcttaagcaacagaaatgtattctctctcggttctggatgtattctctttcggttctggaggccagacatccaaaatcgaggtgtcaacagggccttgttccctgctaaggctctagaggagactcctttgcctcttagcttctggtagtgttagtgaagtagtgttgttgactggggtaaatacccaaggttcgttgtctctctccaagcagattaaggacacagacactgacatacagaggagtgagtttaggagtggaggtttaataggcaaaagaaagagaaaagggaacagctctctcggtctctctcgagaagtccctgaatgggaattccggcctgtggcagactgcaccaaattttatagacaagcttgaggaggtggtgtctgatttacatagggcccacagattggttggagcaggtgtgacgtttgcatagtgcatgggaaggctggccaccccaccctaatcttatcatgcaaatgaactttccacttgggcggcgccatgttgtcttctccttactgtacacatggctggcaaagagaagggagcgtggagccgccattttgaacatacctagaccaggtggccttttcctatgggcacagctgccagcattcacccgtgtaagcttccagctcccttgactatgtctacagctcgattttactggctgctccttgttagaaaagaaaatgatttgggggttgcttttcattaaaaggaaaaccttaccgaggacttccttaccctatctgcctaaataatttcttcttcactcctgtatcattagcagtagcaaatccatacgagtctgaagcaacttgatacttgcctcctcagaggaaataattccaccagcgggcataaggcagagtgagagaccgaggcaagttttagagaaggagcaaaagtttattaacaagttttagagcaggaatgaaaggcagtaaaggacacttggaagacggccaagtgggtgatttgagagatccaagtgcaccgcttgacctttgatttggggttttatatgttggcatgttccggggttttatatgttggcatattccagggttttatgtctctcctcccttcattttccctcagggcaggttgtgcgcatgcgcagtggcctgccagcgcttgggagaggctgcaaacacagtgtatttacagaagtcatgggcctgattatttgagatgtttttccctcaccagttgagtgttcctagaggaaggtcatataccagttagactccgccattttgcctcttaatgtgcatgcttgagcccagttgcccaactcctgagatctcatcgggaaaccgctgataacttcaggtgttttctgtctgttgggagatggcctttccctggcaccagctgtgaccaattattattttagagagacaattttaacaactgcctgacatcacctgatggttgcctggcattccttgggggggaaatcccctctcctttcttgctcatggctgcctggctacctactctaacagtaacacacacaattcttggcattgcttgccttctggttgcaccacttcaatctctgcctccatcttcacgtgaccctgtgtgtgtctgtgtgtcttctcttctcctctttttttttttttttttctaaaagacagggtctggctgtgttgcccaggctggtctagaactcccaggcttaagtgatcctcctgcttcagcctcccaagtagctgggattacaggttcaggccaccatgcttgggtctctttcctcttctcataaggacacaagtcattgggtttagggtccatgctaataagtatgacctcattttagcttaactattataattacatgtgcaaagcaacttacaaattactttggaaatagagtatttccaaatagaagagatataaactggggaaaactatttccaaatagggcacacatgaactttgggggtgccttagtctctgtggcttgctctagaccgggggcttgtaaacaacatttattacagttctggaggctgggaggtgcaagatcaaggtgttggcagatacagtgcctggtgacggcctgttccttatagatggtaccttctcactgtgcctttgtgtggtggaaggggcaaacaagctcccttgggtctcttttataagggcactaattccattcatgagggttctaccttcataatctactcacttcccaaaggcctcatttcttaatactatgaccatggaggttaggatttcagtgggtggcacctgtaggcaagtggaagatgatgggaaaggtatgtggcacacacgcacgtgagcagcattggccaatgacttggagacttgggctagtcataggtctgtgagctgacgcaggccacttgtgtgagtaggtggtttctcctgggagttgctgcagctgaggctggggaatgcctctattggtgagtgacagaacacatggatgaatggcttggagacagaggtttgcagatgttgggggcccagccagttgttgggtgattctggctaagatctagagagcagtggagggcacttgggaatgtcagagtgctgtcaatggttatttggagagtaaagtcacaccacgagctcctgagtgagcaggggtcctggtgagtcgatgggtgttggtgcgtgcttggagagggcagggagcggctctgcggtgctgacgagtgatttggggaatcagacccaacccacaagatttaccacggcaggagcagtgacaccatcatccaatgcaccaatggctgggaatggggagcggctggcaagcctattgcccttcttcgtgcagtggtggactcctggttaatgagagaaaccaactttctgtcctatccaaatattatgttctccttacccctggttctgcttccagatccagaaaaaatgatcaacgtcagtcgtgggcaggcagacaagctgtcccacattttttattctgaagggatttgagcagaaagagcccaagtgggtttaagtttttgcctcttaattttctcaaacctcatcttcagccctctctcttttttttattttttctctttggcatcctagcacttggtgtttgggacagggttagtgtcattggcatggatgattttcttctgataaattggtttaccttcaccaaagggaaaaaaacaactagttccctcccagcacccctatctgagcctctcctcaccccctgcctttgcagaagaccctggctttgtcatgaccatttactgaaggctctcagccaaggccaagcactccactaagccatttactaacactactgcatttcaaaattgtatgcaatttagtatgcaggatgtgcaggtttattacataggtaaacgtgggccatggtggcttgctgcacctgtcagcccgacacataggtattaagcccagcatgcattagctatttttcctgatgctctccctccccacactcaccctgccctctcaatttttttttttttttttaagagacagggtctttctctgttacccaggctggagtgcaatggtgcaatcataactcactgcagcctagaactcctgggctcaagagatccacccacctcagcctcccaagtagctgagactacaggaacactccatcacatgtggctaatttacagagaaaatttttgtagacataggagggtctcactatgttgcccaggctggtcttgaactcctggcctcaagtgatcctcctgccttggtctcccaaagtgctgggattacaggtggcaggcactatgcccagcccattactcccattttaagcctcactgtgtattttacagatgagaaaactgaagcttgaagaggtcaagttgcttctccaagttcatccagagggtggaagggcagagtcaggtctccaatcaatcctggccgctcagctcaagtgcttttttttttttttttgagacagagtctcgctctatcacccaggctagagtgcagtggtgcgatctcagctcactgcaagctccacctcccgggttcatgtcattctcctgcctcagcctcccgagtagctgggactacaggcacccgccaccacacccggcgaattttttgtatttagtagagacggggttccaccctgttagccaggatggtctcgatctcctgacctcgtgatccgcccaccttggcctcccaaagtgctgggattacaggtgtgagccaccgcacccggccagctcaagtgcttttagtggtcaccctctcatctgtctctctgtaattttttgttttttttttctttcttgaaatgaagtctcattctgttgcccaggctggagtgcagtggcgcagtctcagctcactgcaacctccgcctcccaggttcaagcaattctcccgcctcccgaggtggtggctgacagcctcccgagtagctggaattccaggtgtgtgccaccacgcctggctaatttttgtatttttggtagagatggggttgtttcaccatgttgaccaggctggtctgaaactcctgacctcaagtgatccgcccacctcagcctcccaaaatgctcatctgtctccttgttgatgtcttctttccagaaaaagaaaaaaccaaactgcagaagcagagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacactgaatcccaaggaaccccagccttctggcttgagaattcattttgtatataagagaatttcaaatctgtgcctcttgagggaatgttgttccaggaagtgaccagggaggagtcacatcccataatacatggcagagcttccttcacatcctgtcactcctgaaggcaatgtcttgaaacttctgctatcagtttctaccgaaactctgccacctgaactgacttgctcccaacctctgtcctcccaacctcccagctttgttctcccctttcccttccccttagtggcgccaatgcccttttctaagtatcagggtcttctctttgcatctgctgccttgacctcgacaaccacagccctggagctgcagtgtaaaaacatgttgtaaatgttgaaaatgtggaaagctgtacatgttggttcttgatttttgtttccttacaccagagcaaagcttttagggcctttcacaaggaaaaaggcccttccaacccagagggcaacttgctctttattgtctgtgttctcagagacctttcttcaagggtcctgggactagcagttccactgcccttcttcatgctgcaatggacttctggttaatgagagaaaccaacttttccctcctatccaaatattatattctatggtcgggtacagtggctgacgcctgtaatcccagcgcttctgggaggccaaggtgggtggatcacctgaggtcaggagttcaagaccagcctgggcaacatggtgaaaccccgtctctactaaaactacagaaattagccgggcgtggtggtgcatgcctgtaatcccagctacttgggaggctgaggcaggaaacaatcatttgaacccaggaggcagaggttgcagtgagccaagattgcaccaatgcactctagcctgggtgacagagtgagattccatctcaaaaacaaaacaaaacaaaaaatacagaaaactacaacaaatattatattctccttacctccggttctgcttccagatctagaagaaattatcaatgccagtcttgggcaggcagacaagctgccccaacatagtgagacccccctatctctacaatttttttttttaattaactaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctcttcaaggcagttcagcaagtctgcacccacctactttatcttggtgatccttggaagagctggggtgactcgctctctgagacctgcctcatactttgtgggagcacaggtgaatagggtggcttcaaaatacaaggtcaggagaggtgctgcctcactcactgaccccccagcagggtcctgtaatgtccctgcctctgccctggggtcacatacctacctctgggtaagcatttaccccatcattgatatgtgtctctggttcagagcaggttcaccagatacaacatatacatactgtacacgcataacacgtgacaacatacatgccccatccacaaagcctgttgcttaacctattggtttatttcattggttccttgatgctttccttgcttgctgtgtatcttcttttcttttacccatctactttcacagggagcaagaagaagacaaggaaatggctgatttcctgagaatcaagttaaaacctctagacaaagtaaccaaatctccagccagtgagtatatacattattcattcccctcccccacaaaagagaaaagtatatttcaggccaggcccacagtggatcacgcctgtaatcccagcactatgagaggccaaggtgggtggatcacctgaggtcaggagttcgagaccagcctggtcaacatggtgaaaccccgtatctaccaaaaatataaaaattagctgggcacggtggcacacacctgaaatcccagctactcgagaggctgaggcaggagaattgcttgaacccgggaggtgggggttgcagtgagctgagattgggccactgcactccagcctgggtgacagggtaagactttgtctcaaaaaaaaaaaaaaaaaaaaaggccatttcagagaagtctgggagccataaggggcgcaacaaaatgctttctagagatcagatctagagatcagatttcagcatgggatgacagcaggcaggaccagcctcacgggcctgcaggcagttgcctggggcctcatgcctgaccagcctcatgggcctgtaggcagttgcctggggcctcatgcctagaagggtgccatgcttggtttaatgttctcctgttgctgtctagaaattgttaatacgtttggaacatggggccctacattttcatattggattgaactctgcaaactacgtacctggtcctggtagttgttcctccctaattgcaaagtttggtgcatttcatagaaagaattgggtagctactgaggctcagggagctctggcctctcttaggtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtcaagaaactgtcttttctttgttgacccagcgtttctcaaatgtgtttaactgctgtattagtgaggcctctttcagttagaagaaatggatgcctggctgggcgcggtggctcacgcctgtaatgccagcactttgggaggccgaggcgggcggatcacaggtcaggagatcgacaccatcctggctaacacggtgaagccccgtctctactaaaaatacaaaaaattagccgggcttggtggtgggcgcctgtattcccagctactcgggaagctgaggcaggagaatggcgtgaactggggaggcggagcttgcagtgagccgagatcacaccactacactccagcctgggtgacacagcaagactccatctcaaaaaaaaaaaaaagaaagaaagaaaagaaatggatgcccaattcaaactggtctaagcaaaaaaaggaatttgttggagaaagagcaacaagaactagagcctcaaggactgaacactattacctcccctccttttcttctttttctcatctctgcctctctttgcatgtaagcatcattttttcctacaacacaggccttctccatgggaccagaaccctagaaccatagcttagcaactctgaagcaataccacaggttcttttccctggtatcgaaatacataagtctcagggaaatattctcacccgcccttctgggattatgttcccacctcttagatccattaccatcaccaagaggctgggggtactgggattggccaggaatgtataacatgcccactcctgcagccacagggacatgagctgttagaggaagagggacttgaaatcttgctgggaagacaaaaaccaaaagctgccactgtctataaaactacaaacccagttttcattaacatcctgtgaaagatggttggagggagtaaggaaagagaagggcaatgatctcttctgctggctcctataaccacaaggcacgtgatcactgccgaaggccagcatcctcagtggaccctttcatgaaaggcaaggtagaaaaactccacttagcagcatggaggaggagcaaggaaacttgccttctctattggattatgggtggaaaaaagaaatgattctggcgagaaatcaaaacaccaagcatgcaccacatgcaaggggccaactttacactactcatctggtactggaattccaagttgaaaaataaaaactattgtaaaaccagtgaaatctctgggatcctagcagatttagcaaatgcaaaactgctcagtagggattcttctggatcccatggtatacagtattctcacagaaaaaagcaacccccttgaagatgagccctcaataaaaatgaaaaacccggccgggcacagtggcttatgtctgtaatcccagcactttgggaggccaaggtgggcagatcatgaggtcaggagctcgagaccagcctgaccaatatggtgaaaccttgtctctgctaaaagtacaaaaattagccaggcatggtggcgcacacctgtaatcccagctactcaggaggctgagcaggagaatcgcttgaacccaggatgcggaggttgcagtgagccaagatcacaccactgcactccagcctgggtgacagagcgagactccatctcaagaaaagaaaagaaaagaaaaacccatgaagaactgaatcaccatgaggagaatcagtagatgcaccaaagagaatgtcctcccaagaaccaaaaatatagaactatttaaaaaggaaaataaactaagtacttttaaatgatcaaagagctaagagaaggaataaaacccaaaatgaaatagtaagatgctatgaaaaaagaataagtagacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgacttgaacaaaatttcccatttatctatttaccaaatacttcttggatgtcaggccctgtgctaggcttggcaggtacaatgatgataacagctgactaggagaagggctgaaagttagggttggaagctgagcattgaggaccatataaaatgaggactataaaatgaggaccagctgaggatcatatgaaatgtgcatcagctctccataccacctgaacaaggcctggaacaagacctggccaggggttgcagtggggctgggctgcagatggtcagggctctgctcacctcacctctctctctctgttcctttctccccctctccctgtgcccacatcttgctgcaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatcatgccaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctacttgggaggctaaggcaggagaatcacttgaacccaggaggcagacgttgcggtgagccgagatcgtgccattgcactccagcctgggtgacagagcaagactccatctcaaaaaaaaacaaaaaaagtgtcttgggccaggcgctgaggcgggaggattgcttgagtccaggagttcgagaccagcctgggcaacatggcaaaaccctgtctctactaaaaatacaaatagctgggcatatgcggtggcgcgggcctgtgatcccagctacttgggaggtgggaggattgctggagcctgggaggttccagctgcagtgagccatgatcacaccactgtattccagcctgggcaacagagcaagatcgcaccccctggaaaaaaaaaatagtgtcttgataaacatctagggggataaggtttcatctgaattttttattttttccttaagataaactcctagaagtaaaattattgggccattcataagtagcattttcaaaatatttgtaaattggctgggtgcggtggctcgcatctgtaatcccagcacgtcgggaggcagaggcaggctgatcacttgaggccaggagttcgcgaccagcctggccaatacagagaaaccccatctctaccaaaaaatacaaaaattagctgggtgtggtgacttgtgcctgtaatcccagctactcaagaagctgaggcaggagaatctcttgaacatgggaagcagaggttacactgagctgagattgcgccactgcactccagcctgggtgacacagcgagacttcgtctcgaaaaaaaaaaaaaaatttgtagatcaaaaggtctttggttggacaggccctcccagcaggctgctagaccccagtcctcccactctgcgtgttcgcggctttggtctgcacaccacttcccaccattctgatgctgaaaagggtcccttgggctactcagtgccaccacaatggcctcagaggaccccgtgtcctccttcaccaacctagaccaatcatgaagccagactcttcgtgtactggggatgccataatgaatgaccttctactgggtgacttaaaacagtggaaccgtctcctttcacagtcctaaaggccagaagcctgaaatcaacctgtctgcggtgctctgctccctctgtggggaagaatcttcttttgcctcttgcagctcctggtggctcctggcaccttggcagttccctggctgcaccactccagtcttcacctctgtctccacgtggccgcctccgctgtatatgtgcctctgtgcaccctctcatcttaaaaagacaccagtcattggagtgagggccacccgaatgcagtatgatctcatttggaccctttccttaattacttctgcaaaaaccctctttccaaccaaggtcacattctgaggctccacgtagacatgcatttggggaggacccaattccacccaccacagacccctcccgctccaacgtgcagtgaaaactcaggctgcaaagggcccaccgccctcttttccccataaaaaatgtgggtcaaggctgggcactgtggatcatgcctgtaatcccagcactttgggaggccgaggtgggaggctcacttgaggtcaggagctcatgaccaacttggctaacatggtgaaaccccatgtctactaaaaatacaaaaattagcaagtgtggtggcacatgcttgtaatcccagctactcgggaggctaaggcaggagaatcggttgaaaccaggaggcggaggttgcaaagagccgagatcgcaccattgcactccagcctgggcaacagagtgagactccatctcggaaaaaaaaaagggggggcttggggggtccgggcgtggtggctcaagcctgtaatcccagcactttgggaggccgaggcgggcggatcacgagttcaggagatcgagaccatcctggctaacacggtgaaaccccatctctactacaaatacaaaaaattagccgggcgtggtggtggacgcctgtagtcccagctactcaggaggctgaggcaggaaaatggcgtgaacccgggaggcggagcttgcagtgagcagagcttgcggtgagcagagattgtgccactgcactccagcctgggcgacagagcgagactccatctcaaaaaaaaaggggagaggggagtgggggggtcagcgaggtctgacctcaggccagttatacagcagtcactcacagatccaacgaaccagaggagatcaaaccctcatcaaaatcctgcctctggtacttccgctaagctctgggtacacctactgtatgttcctgtaattcctactgatttttttaaaaaaagaaaacattaaaaaatccaatttatttaagctgtcacagacgcttccagattaccagggccaccttccaagctgggaaaccttgcagactgtggggtcctgcacacctagacttgctccttttagaagccatggaggaggttgataatgggaataacatttattgtagcttatctctatgccttgagcaatgtgctcacactggctggttccctcctcacatcagcctgatgagtcagatcctgttattacttctcactttacagatgaggaagtagcagtaaatccattacccttttcaagcggaggttgcaagaggttgcaagcggaggcagaataaacacttgaaacagtgagtcagatcctgttatcacttctcactttacagatgaggaagtggcagtaaatccactgcccacggtcccaggggttgttagtgacagagtcatcattcatctccctccctccccaccactgtagccccaattgttctttctcttcccatcggagggatttaaacaggtctctcccatttaaaagcaaacagggctggacacggtggctcacgcctgtaatcccagcactttgggaggccgaggcgggcaaatcacgagatcaggagattgagaccatcctggctaacatggtgaaaacccatctgtactaaaaatacaaaaaaattacctgggcatggtggtgggcgcctgtggtcccagctacttgggaggctgaggcaggagaatcgcttgaacctgggaggcagaggttgcagtgagccgagattgcgccactgcactccagtctggagacacagcaagactttgtctcaaaacacacacacacacacacacacacacacacacacaacacaacacaacaacaacaacaacaaaaaaagtgtcctcttccttttagagaatttaaaaaacagggtgaaaccccatgtctactaaaaatacaaaaattagcaagtgtggtggcacatgcttgtaatcccagctacccggaaggctaaggcaggagaatcggttgaaaccaggaggcggaggttgcaaagagccgagatcgcaccattgcactccagcctgggcaacagagtgagactccatctcggaaaaaaaaagtgggggcttgggggttccgggcatggttgactgtgtgactatattatatctatacataatatatagatatatatctatatataatatatagatatctatatattatatatagatatatatctctattatatataatagatatatctatttatatatagatattatagagacatctatatctatatctatatataatatctatattatattacgcctgtaatccccgcactttgggaggccgaggcaagtgaaccacttgaggccaggagtttgagacgagccagagcaacatggcaaaaccccgtctcaaaaaaaattagccaggtgtggtggcagcatctgtaatcccagctgttcggaggctgaggcatgagaatcgcttgaacccggtaggaggttgcagtgagccgagatcgtgccactgcaccccagtctgggcgatagagtgagactctgtctcaaaaaaaaaaaaaatgtatttcctgattcttgccacacctgcccttgatgcatcagactctggctgctgaaataccaagggcggcgaccctgcagccccagtgtggatttgtctgcacttgctgataccagaaactgcagtgggggcaggtgggtggtaggagcgggggttccctcatgcccaggccctgcacctgggaagcctttggaggccatcacatgagctgcctgaggcggatggaagagacggtgccaagcaggcccaatatgttccctgctggccctggtactgctcccctgcggatgctcctggttggttcaccacctcgtgcggagtgaggagctgagcagcccagccactgagcaggatttccctctaagaacggccccttccaccctgcaatgccttcttcctctgcacctcagctcccccacttccaaggcgttccttcccggaacgtgtgtattcttctcttcatcttgctaaggaaagttctggctcttggtgctctggcttggcaccttctaagctctctagcccttttccccccgccccccccccccccaaaaaaaagcgttctcagccaggcgtggtggctcatgcctgtaattccagcactttgggaggctgagcccagaggatcacttgagctcaggagttcaaaactagcctggccaacatggtgaaacctcatctctactaaaaatacaaaaatttgccagtgtgatggtgcacatatgtaatcccagctactcgggaggctgagacaggacaatcgcttgaacctgggaggtggaggttgcagtgagctgagattatgccactgcactccagcctgggtgacagagtgagactgtctcaaaaaaccaaaaaacaaaacaaaaaaccactcaggcttagccatttctctggggtcttcatttccttatgaagactctcgcaaaactggtatgaagtaaaatttgtttgcttttttcctattaatgtctttgtcagtttaaggcccagccagggacactaggagaattgaggaagttttgccgcccaccgcccccccccccagcaatggggacagcaggtgggtggaggccgctgagggcttctgcgccatgactcaccctctgcccatggaagcagctagaaagtgaaggtgaatcccaaagcgcaacgctccttctggcaaagggaacagagagggaacagatcttcttcaatcagcgcagccccctctgctacggacaggtctgctctcccccagacagctgtcttctaggcccccacctctgaatcaccttcctaggtgggaaacaaacaaagataaatgcaaagccaccgttccagccccagtccacacctaacaagacctcctgacgccgctcaaaaggggcacgatggctactcaactttttctgcacaaatttgccatcgtgaaatgtttggaaaggtctttagcagcttttaacattgctgaacttgaaaaaaatgtcatcaagaagcaatttactcaagtctcttctgggtccttttaaattcttgccagagggtgctggtggcaggggtgacggggtaatggcggtctcaggggatgggagggcttcacaactgtatctgtggaataactcttttccaaattggcttattcaaaaagcatgcttagcagtgaccaaaaacgagacagcgggcacgctggatttctttcacaagaagagagagcctaggaattaatagagttttctaactggaaggtttttgtggttactgtattttcccacatgtaattataagctggaacaaaggctggaaaacttggaggatcctgacgacgaagggcccaccatccagccacctgcttcggcgtgtgctgagtttaaaaggcctctaagatgtagacggatttactctccacctcacaattctatttccagaaggggagagaagttgaggagacccaaaatgaaagatggcagaactgtattggtttgtaattcctccccacagacagacagacagacaaaaccactcacttgggaaactcaaaatagatgctcgcttgtaaagtttattgacaactgtttggtcccaacacacaaaacagcacttgaaccacaacaaaagtgttcaaacaaagtagacaactaagaaaaacatctctttcccccaaacccaatccaaaacaaacagtgcaagatgggaaagggggttttggtgataacttttgtcatttttttaaacagataaatttaatccggtatatctttccacccagaaataaagaattacattgtcttaatgctcaaacatcattttaccacatcatttaattaagcctctggataaaaaaatagatagcaattggactggccattgtggagtacattatgaacacaatgtgcttccgaagtcttctctctcattttcagacagcaattgttaagagtcacacacacgtcccagacctaagcagcaactccagtgaatggtactcagacacactcacgggacagcacagaacttgattcttctttgtctgttgcccaaagaacctgttctttgagtctgttccaggtgacttgtaatgatacctcttacggttttaaagtccaccactctttacatgctagcagaactgaagtccaagcgtgcaaactcagccttatgaaatcttagaataaggcaactgatgttctcaacaccaattattattactttgtttaaaagctcctttaaaaaaaattgcacatttgcatttcacttcctgtaacactatgtctgtagaggaaatgccttcaggaggattcggagagtgccataatacttacagggttttttccatggtgttctgtcttgactggggccatgtgttgagaactgggagtcactggcttcatttaaaagatttggggaacaaaaaatctgacttgtaaaaatctctctatagcccttattttgtggcattttatcaaaatgctatgaaatcagagtccattttctggctttctagaagttaccaaatataaacatttccccaaaagaaaccatctaactagtggaagaccttacgccaacaggttctttctgctctatgaatgaatccgccttttttgccggacaaatacaatccattgtaaatgtcaggtttctctagaggggggtgagaggccacccgtcagcggacacctcaggcacctagagaggaaggccattccacaccagacgccacaagaaacccagagatgcttccaacagcgagaagtaacgagagtaaaatcagacacgattaaaagatgctgagctgacatacacacacataaagcttcccagctaccgataccagctttaaaattacaataacaaggttaagtggatcaaccttggccttcctatgtgtaggtagaattcctgtctcttcccagtggaaatcgtattgatcccgctgctgctgaagcacctccccactcagctctgatttgtaatttatgcacttgatgcatattttagaaaatcaggctctttccaatgctgcctctcgacacacaataatgtgtgttgtaatccaaatgctgactttaaatccatgacatcgagaccatctccttttccttaacctaacccatatcaaactggaacacagaagggaagcttcaaacatcctcaactttctagaaagctcctaaatggaaccccaaagtagaaacgtttaaaaaaatttgtgatgaagccacttttgtcaactacagacatagtttaaataaaaaacaaggcacacttacaagtcacatggaagccaggaaccttcacattccaacctgaaaatacactccgaacccctcgcctacccttctcctttggtgtgtgaacacacaggctagcgggacaggctttgcttcaaagacatgccacgcactgggttaatactgtcggaaacaccagtaagcaaaggctgagagactctattatgctacatgtaggatgacaccaccgacgtggctcaatggaagcaaaaccgcttcctgctagttgagtttttagtgctttcttcttttggaacaccattgtatttcataatagttactaaaaatttggtaaaatatattaaggattctttaacaaatgccacaagttcttcaaataattgaaaaaagaaagaaaaaggaagaagaaaagaaagacttcagctcaaagctgtgttcaatggaaaagaaaaacatgatagaacacaggtaagatgaagtcaatggcttcggggggttttcatgacacagaaaaggatgtatttttgaaacccacttttgtgtgcagaatcagacagtgttttcccatcctaattctatattccaaatgggagttaaagcttggttataggtgctaaggaaaagttggctgccaatttgactctatttttgggttgctttttggccgggctttccacggggtccttgctgagcagtgactcggaggtttccgaggaggggcagggaggcacggggacagctgctgagatgcaggacgagctggagtcagaggtcagagttttgctctttcctggtattggaatctccattttttcttcttggtttaaaatcataatttctgtaaacacagaaaagcaaacagattcagatccaggaactgtaagaagtgtgggttttctcttccttgctcatattttctcaaaagataataatagtaataaaaagcttctaaatgctacatctatgccacagtttacatatgagttgtgtggccagtgaacttggcacagaaatcaagtatctataaactgcatcccacctctcccactggattacaaagttggaaagatctctattttgagctataaatgaatgagcaaaggttaaaactttttgtttttccattttggattctctgcccattcattctgcctgccagatattaaggacccataaagctatccacgacttagagacttcctgaggcgggaggccgtgggtggtagggggtggggtcggagcatctgggtgtcagggagctcctggcctgctccatttagagaggacctatgctccccatgggtctattaccggggataaggaaggactacgcagagtgagaattaccctcagaacccaggaagttgagcacagccagctttcccacagtgcttctggactgccatttctgtggctgagccacatgtaattcacctgctctacacacagggccacgctgcttgaaagagatgcatcattatgccttagactcccactgcatagggcacagggctcctgctcccaaaggcccatggaaggtgagagtggcagaggggacagcagagccagctccctgcctaggctgaccctcaagagaagagcggctgacagaactgcccacagtgttttaattattttcctctcttgtccggtgcatgcagttgaacttgcccagactgaaggcacaaaggccacaaccccacaaacgagctaacatcaatgtgccaccaaccctaggggggcactgcacaggagcagggcatggtctaggtctgactgcacaggctggttctatccgcaggcagttacttccccatctcctattttccaagtcaacagcctcagttcttttcctgggcaacagtgctgaacgctgccaagaacaaccaagatggtaaaagccaagccaggagtccacgggttgttcctggtgacctggaaagcagcaccagcagtggggaggagttgggttccaacagatgaagagcagggagggatctgtacagggcagatgggccatcctctccagaggccaggagacaccgcaggacaagagggcttgggttccaatgccggctctgcccttgctagcccagcagcccggggccactgcctctctagtgacggcaccagctgtgccttagtcacgcagcctgtggaataaagcagctgcctttattccacggctctcacctggagccgtggtaagagttaaatgtgatggtgtctgtcagccctgagcacagggtcagtgccaatgcctgcactaggctgggactcagtgtgctcagcttcctgtctgttatatcactgggcagagtccggggctccagccacagacacctccctccattcacccctttataaagcccttgggccctctggacccccaccatgggtgacgtgtacatctggtgacaggtgtgcctgagagcagctgaaccttcacaaagtctgggagagcagaagcccaggaggccccacccacccctgtggactcgcccacagccccgagccaccagccctccagagctgccaaatcgcccttgcctgatgctcgccaggcaacctcaggctgtgcatcccattctgcaggaacccaggtggggaaagaaggtcgaataatcagcacagtgttttccacctgaaaaggggtagtcccttcccacctccgtcatttactatatcagtatctcatcgtggttttgttttaaaccccgaagaaaatccccatgacaacatggagtcacccaccagaaggctcttgagggcgctcctcaaactgaatgagatcagcagattggaggataacggggtctggtctcagctgaggggacggcaggcacgaggggacaggcgcacacaggaggtcgacgggggagtcgtcggtcaggcggagaagctcctgctctgtgtgactgggccctgggcaaacaaggagggccgtgacaccacaggacctccacgcccacccccagcacacaccctgggctcacacctgaagttttccttctaagccttaaagataagagagtcaagaagtatttaaggtattaaaaaaaaaaaaaaaaaaaaacaaaaacccaaaacccactaacaggaagatcctggtaatggaacgccttaataagctagttcttctgaagatccgtgttcttaggaacactggcccctcaaaagacccaaccagagaaaagggtcctgcagtcagcttccaaagagaagggacagcctgagacggggtgtacgtagttaacagcaagtggaagctcagaatccgaagccctgggcctggttccgtggcttcctagctgctgactctgggtgagctgtaatacgtgactgcctgagatttccgagcctccgctgcacaacggaggtcagcactgctgaaggctgtggggcagcttcggcagatgattcccaggagggcgcttcataaaacgtcaaatgctgtgtaactcagttatcctaagggcacaggggacggtaacgtgctatctcgccgcatgttatgaagacaaaattctcacctataacgatgaattcaaaagtccttcagaaaagttagaactgctataacattccaagaattggcctctatctactacagaggtggatctatctgaaatctatgtgactcagtgtaattttgggtaatattaatgcattagtatatcaaatcctgcctagggctgtcctgtgacaaagacgccttgaccagccatgagtcaggcaccctgagccctcttccggatcaggcctgaccttggccttccatgtctgttgctgaacttgccggctcgctctagagtcttagcttgagtcagtttagtgagaatcccctcacccttcacagctgatcgaattccttattcccaaccactgatgtctagatccttggctggcctgcatgcctatagcaagaatcctcttagtaattttccacccactgagccctcactctgctcctaggctatgtattgggagttggctctctctcccctgttgcaagtgtcatgaatatccattataataagtgtcggaataatttttttcttcaacatctgaactggggtaagatgatcattatgggggtgccaacatccttcagggactttaaccagtcaaccatgcaatgctaacagataaaggtcaattttatcctgttactaactaaataccaaaactgctttgaaaaatgtgtggctatgtaacttcagcagattggatgacttgctggagtcctttccctcgctctccccgaccccaaagccgtttctcctagaatttcacaagctcctatgtctctgcttttcctctcttaccactgccgtcagctccaagcttgagttccgaggctgtgtgcgattcgggcacctccaggatgcgctcgccctccgagggctggttttcatgattggcaggggagagactgagtgaactcaaacgacctacaggacaaagagcacccgtcagagagaaatgtcagtgagagaaccgtgattttttaaggggggaggggatgggtgcttacttacttttcatgtcattttttaacactacaattctcttatgaccatgtccttttatccagaccacctgcacacaagacatactactggttaagcagcggaaaaggaggggacagaagccctaacattcaggaagagtgtgacctacggagcctgccttaggctagaatttaggagctgagttactgccaagaagcatgtttctctactctctccttagcttttaaagcaacagaagctgacagaaacatacccctataaaaagcagagtagttcaaaaatcatgagacacagtttcagaaatatcctttataattcttaaaaagactgtcttccaaacaccagctttggcatataaattaaggtagttctcacatgagagctctttgccatttttttgcagaaactgaacaaccacctaaaagaattaagagcaatctctcagaccctttaaactaagttcattatcagcatcttaaagtcctctccctgatggtgccgctctccatctcagccaagcagagtggtagtagtggagctaggctcccaggccccctacatgtgcacaccgtcgccaggtcactgatctcagctcccaggcaagctttgcctgggtccttcctacttcctctattctactatttttactctggctcaatccctccatctaacactgacccagacctctgcagtggccaggatcctagcccagttcccttctccatgcctgcttctctcggctctaccatggacagcaccactggggtgcttttcaaatgcaaacctgggctccagctctctccaacacagtcctccctccttacctggaggagccacgccctccctaaccgagctctcagctccctcttagcctctcgacactccatgccacttgtcacaaccctgcatctgctcatgtcatcatcccctttgcccagaatgctctctcccctccttgtcacgtgcttccctcaggcacatccttgaaggttttgcaacaggctccccaggcttgggaagtgggccctgacacggccctcctcagcgcgcccactgccctgaccgccctgactagttgcctgcttgggggtcttgactctcccattaaccaacacctttctagagttacagcctgaaacttactcacctggcatatagggatttaataaaggtttacagaaagaatcaaggagaaatgctaaaatcatttactttagaccaacagtatgttttgaaaggatcaattcaaaatgcctgccgttccattattctggcagcattttatttttctgttcaggacagttagcctgtggctgttcagaagatgctctcccggaagctgagaaaaatgcccacctgtggaattgctcccaagagctcctccacgctgctgtggccgtaggtcttgggctgcagagtttctccgacatacttggtataggccatggaaaactcatgaaggaaaatctgctggtagtggtaagtatgaagtaaagaccgcacattctttgcaaacaaatacagacttgtgagcttcacacattcttccatcttatcattagtgaaaacctggttaaaaagaaaacgcagcattagaaatattagtgactggccctgccccgtggaaagtgaaggcctcccactgagggaaaaggcccagagttgaagacgaagacaaagaagaaaaagaaggcaacgaagatgagaagatgaagatgaagaaggagacaaagatgacgaagaagaaggagacgacaaagataaagaagacaacaacaaagaagatgaagacaaagacgacgagacaaaaacgaagataaagacgacaaagatgaagacaaagaacaagaagacgaagacaagacgaagacgacgatgaagaagacgaagacgacgataaagaagacgaagacgacgaattggacaaagacaaagatgaagaagatgaagatgacaaaaaagacaaagaagaagaaaggaggaggaggaaggaaagaaggaagaggagaaagaaaaggaggagggatatattcaaggatttcctccaagagaaggctatagcctccagcaaacttcagttctatttgcaagtcgaaggctgcagcggtctgaagagacagtgtgtgagtagggaagaaatcgggggaggcaaactgtgttggcaaatcacggtacacacagtgaacactggggccattaaactgcacctccaaaccagttttccaagaaacactgtgataagaggatgacactagcattctttaaaaacacatcaaaagcaacaagaaacaaacacaaaacccttgtgtatgcagggtaaggaagcagatttctttaccacaaaccttttcaaagtgtttaacatgctatggaatcgccaagagaaaggatattcccaatcttagctggacagggaaagtcctttgtcctgaaatatgcattaacacctgtccagaactggtgttcttaggatagatattaacagagtttagaaaatgctggatgtatatcctttcattatttaatgatgtgtcccacagttagatgataatggcatatcattcttttaaattgctggagctcatttgttaatatcttatttaggatcattttaagggactatcttatgtttttggtattaaatttattttggcttcgtaaaaataaatggtaagctttccttttttctttttcagcagcctagaacagtattttttttcttggggatgggttcttgctatgttgcccaggctggcctcaaactcctgggctcaagtgattctctagcctcagccttcttagtagctgggattatagacgtgtaccaccttgccgggccccagaatggttttttaaaaggtagatttatctgttcttttagggttggttgaaattcaattgttatctcacttggtcctgatgcctttttcactggtatatttcagtgatcttttatagtctcttttatggtaattggtctaatttttaacttcttgagtgaattttggtaacttattttttccaggatttcatttatttactctaggtttttatatctgtcgcccgagaattgcatgcagtattctcttaagattctctcaatcttggagcgccattcttgaaaggctgcctgggggactggctggccaaccttcctttctgccctcaccttactcatctctctcttcaagccaccacataaaccatctcattcagaaagataaaacagtagcgaaatccatcctggaatgggacaaacacaccccagagccaggatcaggagaccaggctttcatcctagaacgggacaaacacaccccagtgccaggatgaggagaccaggctttcactggcttctgccacccatttaggcagggctgcttcactgcctgaggtctcggcgtgttcatccatgaaatggtctctcgggtcccttccagctctacacactctaatctagaccatcaggtaatccggaaatgcccaatcgatagttttcaatgatagttctaaagagccattaacgtgcctacctcaaccaagtatggcaggctcttcagcagttcggtcaaggtcatgaatccatattcacaggggttaaggggagtgttgtgggtactttcgtaatgtctcttgagctcctcaacagaaagatgggtggttccttcccaagacatcaacaataccagcaactgggcagtgagagatcgcagagactttcggttgatcagctgaatctgtctgccagattctatatcggcaacctggggaaaacgagaattcacacttttcagagctcaagagagacaccctaggttatacccaactcagctcacttcattttggttaatgagaccaacagatgaaaaatctctaatttttttctcttacactgaaataaagcaagtgggtttgtttttagcgtctttgggacaccagaccaacatggaagcagaaactgtcctccccctgccggtccataactgaaaactctcaacaagataataatgggggaggaaattgcatcattctctttatttttcattcattctttccaaaccccactataagaaggacacagactggccagctgatggccagtggtccaagcttgtgaagtgtgggttgctgtgctcgaaggggggtagggatggggaggctagactctaagcaacactcacatggcttctgtgcagacccgacttgcccatatgcgtccccagggcgggctggggaggtgagagagggcctactctgattacaaggcaagctgcatttttctagtctgctattactcaccacaaagctggtattttcatctgactagtaactgtccactcctcaattatttcagattctcaaggagataaagggtttaagcggttaaatgcgctgagagggaaaccttacaaaaaagacagagattgtcacttggggaccaaacaccatgtgaagaaacacgcatctggtgactgagccagcaggctgtgggtggcgagggtgaggctgtggcgtgagcctttcctggcacaaaaacaggcagagctttggcacacacacggctccggcactgctctcacaaaccaatgctcatcctgacagcttgtttgccccctttatctggttttcctgccagggccaaaggtcttggcagggctaagtcaccacaagttggcactctttggaccgtggattctgagaggcagagagaggtgggtggcacttgaggagccatcccaagaccagggcatctttatctggttctgacatgtgcccagagccaaggcaggagggaggctggcagggtcccaccctacttatcatgattatgggactgtatagatttcctcctcagaagcgggtttaatcaaccaaccgatacaagtccaggggatcccagtcatcttagccacccagacccccaccatcactacagctgcttaggaaagaaaccaaaccagagcctgctcctctggtgcgacttggatccatcccttgattctcaatcccggctatgcattagaattgcctggggagcttttaaaaacaccaatgctcagagtgtgctgggactaattctataagaatctgaaaggtaaggttggagaagctcccaggagacccagtgggcagccagggaggcaccacggagcctctctcagctctccccattcttgctgctcacaccccagctgcccacccatcacactcacccagcaaagccctaggtcatggcgtggggtcttcctatccacctgagtccacccctttcatcatcctgggcaactgaacacccagggacctgtcccacaccacagccgtatagcctttcaatgccttgcctctgtcatctccgacgacatcctcctgtgttcaatttcactgcagacacccatctccagggtcacagtgcaaacctgtcattaccccatccaacataaatcattcaaacctcctgagcatcccacttgcaaaagcaagtctggagctgctgttggggtgggagtgcagaaagagactctacccgctcaactccgccccttctcaaacctcagcagcatcactgcctcctatctgctcccaatttgccagcccactcccttgcttcactctcctcttttgtcatgctggcactgacattcttgtcaatatttaaattcgctcatcccatgccttttcctgacgcccatcggtaaactcccaccttgaatccaaccacctgctttccctgaaccgacacctgcatagccacaccccaactgctgctctcccagagtctacggtgccaacttgcagtgagctctcgatacccctgcactccacgtgacatcctgatcaagccactctccactcaccatgacaactgtggaccttctccccactcctaagtcctgagccctgcctctcctctctctctctaagcagagatcagtccctctctctagtggaaaaccactcttggaagaggactcccttctattcctgatgataaacatcagacctgcccatgcctgcccccagcctattgccctgtatacttcctccttcctctgtgtgctgtttcctagtctcccacacctcaaggccctcctgtcttaccccttctcgcccttgtatgttcatcttctctctctagacagatccacatcaatggctttcagacatgctcaagtttttccaggtaggaaaaccaacagcccaaatcctcccttgctccctcagccccacagcctctagctgctgccacagccctccatcttcacaagcagacaaaccaggatgctgtccagatgacctgggccattttctcacctctcctcactcctcaccacactccaaggtggcttctgtctacacaaccaacactgccactgacctggccagcagcaccgactcttcccactgagctaaacctggaagtcaggcagtccctctctgaccagccctcctgcgatgctgctggccattcctctgccttggctcagggatgttcggctctcctggttgtgcttcctgctctctcacctcctcctccaaccaatcagtacctaaggagagctctgagcgttcctacctctgccaaggtaagaacgtcttcttagctgcagtccaatacattaaaaaacagtgggggctgggtgcagtggctcatgcctgtaatcccagcactctgggaggctgaggtgggcggattacctgaggccaggagttcgagatcagcctggccaacacggtgaagccctgtctctactaaaaatacaaaaactagctgggcgtagtggcgggcgcctgtaatcccagctacccaggaggctgaggaagaagaatctcttgaacctgggaggcggaggttgcagtgagccaagatcgcaccactgcactctagcctgggccacagagcaagactccaactccaaaaaaaccccacagtgggaaggaaagggagagtgaacccgttctggctgtttacggaattaaatgacacagaaatgtgtgcagctagtaatgggcctgtaactgagggtgccgtccttcatgcttccctttccattccttcctcctggcagtgacttcttctggtcctgtgggggaggaggccgaaaactggcagctgctctgcctaggacaggaagggtcaagtgcagtccaggacagcaaacagcacgagctgccctctctactacagctctgccagtgacaaaggccactctgcaccctcgcttgctcctaagcctactcctaagtgggtgagaatgtggagggagaggacactgtgtgattacgggctcccaagaacgtcacaggcaaaactcacactggaaggagtcaagctcaggccagcagtgctgaggcagctgcacctcatgaccgaaccctggggtgaagagtgacctcatcagttcacaaaggcattgctttggcaaggccattcagaaacacacaagaggaagaccaaaactctcaacttccaaaccaaggcttctattacctaataagcactaatgacacaaaacgagtcataatgctgtgacagttaagtagttcaaggtgtaaataaagaaacgctacagcacacgcaaacgtcctaatgagaattaggtcactgtgagttttatcccatgagggaaaaaaaaaaaaaaaaaaaaaaacatttaccttcacgacatggcagagtttctgagttaaagccgaaatggaactgacatcatagtcttggagacgaaatgtataaccaaaagttttagcatattctgtaaggagatctgtcatcataaggcagttatctttttgggaccgaaggagtttaacaaactgggcagctagagctttgaaccgctccacctctgtcagagtaaggatcttttcttctccacattccaatacctttgaaaacacacggggggaggaaagggaaaataaacaaatcacgggtgtttacagaatagcaaaaaaagtatgcagctagtaatgaaaaaacaagtcagcgttactgaatgggtataaagtttcagttgtgtaagatgaaaaagttcagaagatcggttgcataacaatgtgaatgtgctgaccactactggacaggagatataaagatagttacgaaggtaagttctatgttatgtgtattgtgccacaataaaacaatttttaaaaagcacttcagtagtaaaaaaagaaaataaaatcaacaacagaaatttggtttaacttagcaacagcgaacagcttagcactgatgttacctcatgtactcagacctaccttcaacacgaaggattttaaaagtataaaagtaatgaacaaatattcagtgtaagaaatcagcaggtgtggtggctcacgcctgtaatcccagcactctgggaggctgagacaggcggatcaactgaggtcaggagctcaagaccagcctggccaacgtggtgaaacaccatctctactaaaaatagaaaaattagctgggcatggtggcgggcacctgtaatccccagctactcgggaggttgaggcaagtgaactgcttgaacccgcaggcggaggttgcagtgagccaagattgcgccattgcactccagcctgggcgacaagaaagaaactccgtctcaaaaaacaaaaacaaacaaacaaaaaaaagaaaacctactgaatctttttttcaataattacccccaaaacaagtttgaataatcctttattgaaggaaaaagccatatttatctaaaaatactaatgagtcaggaatatggcttctctgactggaatagcttagattttcatcctctttcgtaactccctacttcccagaaaaacaggtctggaacgtgaaaaagtatttcctatacgttgttcagaaaaatactttataaaattagaatttcttcactcacttgtaaagtatcaggtatggcttcaaaaagttcaagtagtttggtaaacccatagtacgcaagtttgcactgccggccaaagtggtgatggtaagaagggataaatttattaaagggcatccggaaatggggttggtgacgcagcaaatcaacgacatccttggagaactgttttgtcctttctatttcatcctgagtgcgttcttttaaaaaaaccaaaaaacataaaatcacagtttttttctacccatttgtgttcaacatccacactagagtaaatccttttgggaatttataaacgatatcatccttgccttccaaacacacacaacctaaaacaaacacatatactcttccctctttgcaagtggttctcaaacatgttccagggcagaacaccaggaagttatgatattattatattatgaaattcatatatattcatcttataagctagaaacaatgtcatcttataagctagaaacaattttctagcccctgccccatatctattaacatgacacacacccaggtccctgtacttaagcaagtactctagaaattattcccatgaaatcacgcttctgaatatccccactttttttgtttattcatctgatcttcagttaaaacttgctagcagaagagagaatcaggcttcaaaagttgaacaaaaataaacaggagggaaagcttaagctgagattgtttctattaatttttaagtgagaatgggccctggaattctatgatttcatggacatcaatgttctgcaggagcaccgtttaagaaccagataatagaaggaggatacgaccatacagtcaccccttggtgttctcaagggatcgggtccaggaccctgcctggataccaaaatccgcacctactcaagtcttgcggtctgccccgcggaaactgcagacacgaaaaattggcccccagtatccatgagtttcgcatccctcaaatactgtactttctacccgtaactggacctgtgcagttctgacttcaactattaaaatttgaaaggcaaaagaaaaaaaaacattcgagttgtcttcccttctcaagtgtgcacagtaaataaagtagctcagagttcaacagaagagcaaagccaacaggcacggtgacagattctcaactggatgactaaggctcatgtagccacagccaggctgcagaaggcatttgagcaaagtgctgatgatgcccctttttccccttagagtcaattctaaaaagccagcctgcttttgttcttgagaacagcttcacctactttgaagaacacagaatccaaagagcagcagttttcacactgtgctttctgtggaatcttcaggaagcacggacagggagggaaaaccacatcttccatgccacactatgttaaaataacaggagatagacaatatccttccagcaaatgttaagtcacatacctcttttggggatacaaatcaccatttcattatcttgttgggacaagcagatggttgtgtctggaatctctgatacgatgtcaatcaactcacaaacaccatattcagtgacatcccagtcctttgagaaacacctaggttttaacaacggaagtggatacggaatgagtagtatcatcggtagaagaactacaagttttccggccgggcgctggggctcacgcctgtaatcccagcactttgggaggccgaggtggacggatcacgaggtcaagagatcgcgaccatcctggctaacatggtgaaaccccgtctctactaaaaaatagaaaaaataagccgggtgtggtggcgggcgcctgtagtcccagctactctggaggctgaggcaggacaacggcataaacccgggaggcggagcttgcagtgagccaagatcgtgccactgggcgacagagcgagactccgtctcaaaaaaaaaaaaaaaaaaacaaaaaactactacaagttttccaaaagaatgcttaatagaaatactagataactatttagagtttggcagaagataaaatgtcctaaaatatttactttcatttctgttcttttcatcaactcaccagtgataagcctgtgagaattctctcacaatgacctgtttgctggcctgggatttgagaagttttagtaaatcctgagtaaagcgcttcacctgggccctgtgggtaagggtcagcagacgtttggagcccattccaagaatctgcaaagcaaatagtttatttatacacataagacctcagcagacagcgacttccttgctgctggctcaccctctcgttactagcctcagagcatgactccctttatgtagaatgtgtgcaatttgaaacacatgtcgatcaacaaaatgtagttggtcaaaaggaacaaatgtccaaggccttctgaaactcttatcgtttttggcctggcacaccttctcccaaacagtcgttgagtataaaaatgaaaagtgtaatcttttgaaaagaaaagtcgtgagtacagaaatgaaaactgtattggttgtccagacaaattggtctacaagtttttcaagccgtttttagtgagtgggaagctgttataacactgtgagttaactggtaaaagtcttcataggatccagtgctacactctagcccagtaacttgtctccaactagttaaatttagaagaaaggttaagcccttgactctcacataggcaccaacatacaagtatgtggctattcatgggagcttccttgtaatcatgaacagttctggagaaagctgtgctgggatgaagaaggtctatagagcttagagggaaaatactcctcagtcctccaaggagttcctctaaaactggaaactagcagcgttctgaaaaattgagaagccgcctgtgtgtgttattcctgccctctgaagaaagtttttagtggatgttctgcccagaactgacttcttaggaattaaactgtttctttgatggaggcagccaaagccatggaggaacattcctgcctgtaaacaagtaatcccgtgacacgccttacctgcaatacatgaggcactgcttctaataactcaatcagcttggagtatccgtagtctgacactcggcactgctttgcaaaatgatggtgataggatgggatgaaatgactgatgggtatgacacaagatggctggcttttcagcaagtcaatcacttctctactgaactggatcagctgggggttacctacaggactcttcgaacgcagaagccaagggtctagaagaaaaagaacgtgtataagacagaaagcacagatttcaccagctgaaagaagggaaaatggccctgcagtccctggcttgagttcgatcatggggaagcaaacaaaaccaaatacagtagctgctttacgtctcagtttctatattcaggtctcatagtccaataactagctaactaacttattcacgggctgtcaaatgctgtcccactaatcctcaaagttaagcggccaaggtaaagcagagtctactatagtgttatttatagcagaagtcaaagtacacaagaagctcccagtttagaaactagttatatttccaagatccttctgaaacttggtcatgtggaacgtacctttccacaaagttataaatggtcatcaggtaggtggcccagaagagcaaaattaatccatagtggagctgaaaacgttacccagaaaaccacagaaagtgataatgttgtaagattagcatgacataaaagggtgtaaggaacaggtttttgcaccatcttgactgcttatacctattaaaaaggtataagtaatcaaacggaaatctttatagaaaggtggagaggcttgctggtcgcggcggctcatgcctgtaatcccagcactttgggaggctgaggcgggcggatcacgaggtcaggagatcgagaccatcctggctaacaaggtgaaaccccgtctctactaaaaatacaaaaataaatacaaaaaaattagccgggcgtggtggcaggcacctgtagtcccagctactcaggaggctgaggaaggagaatggcatgaacccaggaggtggagcttgcagtgagcctagattgcaccactgcactccagcctgggacacagagcgagattccgtctcaataaataaataaataaataaataaataaaataaaataaaataaaataaaaagtggaggcttgtgggctcatggcttaggagaaaggaggagtggcataatctatggcccctgagaagtctaagacagagggaaaagaaaggaggtgtcccgtaagaaacctgagtacacacattcctaagagcaggctgactcagaaagaattccttggttatcctcaccttttttcctgtagggtaagggaggtgggagaagcaaaagtgttggggacaaagaggaggaagtatgtgtgtatacacaggaaggcaacaagtaaagtgtcgttcacgggcagcagccttggatatctgcaactcaggacatgcccgtaactcagacactcacccaagtctaggtccaaataccttggtcttttaaatttattttcacatttatcaaagtccaaaacgtggaccaaaatgactttcgaaggtaaatctgcattaagtggtatttccttcaaatacctgaaagtacttttttttttaaagacagagtttcggccaggtgcggtggctcacgtctgtaatcccagcattttgggaggctgaggcgggcggatcacgaggtcaggagatcgagaccatccttgctaacacggtgaaaccctgtctctactaaaaatacaaaaaaaatagccgggcgtggtggcaggcgtctgtagtcccagctactcgggaggctgaggcaggagaatggtatgaaccgaggaggcggagcttgcagtgagctgagatccggccactgcactccagcctggtgacagagggtgactccgtctcaaaaaaaaaaaaaaaaaaaaaatcctgggcgcggtggctcacacctgtaatcccagcactttgggaggctgaggcgggcggatcatgaggtcaggagatcaagaccatcctggctaacaaggtgaaacccgtctctactaaaaatacagaaaaaaaaaaaaattagccgggcgtggtggcgggcgcctgtagtcccagctcctcaggagactgaggcaggggaatggcgtgaactcaggaggcggagcttgcagtgagccaagattgtgccactacactccagcctgggcaacagagcaagactccgtctcaaaaaaaaaaagacagagcttcactcttgtcacccaggctggagtgcaatggcttgatcttagctcaccacaacctctacctcctgggttcaagtgattctcttgcctcagcctcccgagtagctgggattacaggtgcccaccatcatgcctgatttttctatttttagtagagatggggtttcaccatgttggccaggctggtcttgaactcctgacctcaggtgatttacccacctcagcttcccagagtgctgggattacaggtgtgagccaacaggcccagcccctgaaactatttttaaaaggtcagtcaactggcaagccaaaagcttcacaaaattaggttgctaaaaggatctgtaaatgtgaaatttgagtttcaaattttttacatagcttatgttggtactttcaaactggccaggtgtggtggctcatgcctgtaatcccagcattttgggaggccatagtgggacgacatcttcagctcaggagttcaagagcagcctggacaacacagcaaggccctatctaaaaaacaaagtctaggccggttgctgtggctcaggcctgtaatcccagcactttgggaggcggaggcaagtggataatgaggtcaagagatcaagaccatcctggccaatatggtgaaaccctgtctctactaaaaatacaaaaaattagctgggcgtggtggctggtgcctgtagtcccagctactcgggaggctgaggcaggagaatcacttgaacccgggaggcagaggttgcagtgagccgagatcgcaccactgcactccagctaggcgacagagcaagactccgtctcaaaaaaaataaataaataaaaaataaaacaaagtccagtaacgccaacccctcaagcattttaggaattttcaaaagatcaaaggacacatccatggtgttttcacacttggcaaattgtgctgctgtttaaaataaaagccaatagcctcctctggtctcatagtggacaggtggtagctccaggacaaaatacctgacacctaccagtgttgggaggcgggggcttgttgtgaatccatttaaccactttgatgccattctgagcagtggcaatgtttacacctggaacacaggtaatgaagtgttctaagggaacacctccttggttttcttgcactacttctagatcgccaaactctgcaatgtaacaatctggaaagctgaaataggaaaaaacaacaaaaaaaggaaaggttaaatcaaaataacagaaaaggaggcgcttgctaaacagaaggctttggtttaatgtatgtgttaatcatttgtctgaatgcccaccaccaggtttgaaggttaaaattaaggacccagggaggcaagcactgaggcactggcctctctgatgcattctgatggcattttctgggtagttttccaggagggggattaaaaatagggcaactgggctccaagtcagttacgcgtctgcttccacatcagcagggacgtgcaggccactgagtcctgtgttggcctttgtgttaagtctactgttgtggctcatggagtgattaaatgaacttctgaagaatacttttctctcacaagtcttgaaatgtatgcatatttgaagctgtgtactctcaacacttgtggagatttcgactgcagcacttatgatacatctcccctctgtggaagaatctgccctcctcacgtttacgtttctaaaatgtagcgcaaacacacattttcttgttgaagtactgagtgaatggatcccatttcagataaacagtcacgtgctgcttcatgatggggatatgtactcaataatgtgttgctgggtgattctgtcacctgagaacatcatcaggtgcacttatgcaaacctagatgctgcggcccactgcacacctaggctggtgcagcccatggttcccgagctacacatctggacagcctgttactgtactacacactgtgagcaactataacacaatggtatttgtgtatctaatcatcgaaaggtctagtgaaaatatgtgattataatcttatgggaccactgtcctatatacagtccatggttggccaaaattttgttatgtggtgcatgactgtactttgactgaaggctaaacacatgaggatgaagcattgtagagtacttatttgtaaagagatgtgggcagaaagggcaggcttcctataaaaagcagaactagggcattatatcgacaaaggctttgagatggttcacctcaataaaggcacggtgccctcgtgggtctggagaagactgtgaacctggggcgcaaatgtcttcaaagaaagaatcacaaaaggaatcttgtaagagtctggatcaaattcatgttcgctgaagaaaagagaacacaattggaagctgacattccgcaggggtctaagatgttcacaaggtcatcctaacatgttccacaatcttatagaaaagaattacttctaaaggaaaacgaacggcacacctgaaatccttattggaacaatgctgtctgcagacaggctcgtgatattctaactcttcaaatataattgggctgcaattcgtggaggagccgtcgtgtgactgggaagaccccaaggggctctggcgggcctgactgctgggtaggagacacaccagccgtccgtttccttgttcacggattgcgaccgtgtctgttaatttatatagatctgacacattcaacttgtgtccaaacctaaaagcaagagaagagagacgctgacttagaaggtttttctttgattatacagaaacacgcatcctgtttaaataaagaacaataaccaagaatggttcctccatctcttcaaaggtaaaactggaataattctactacaaattcattcactagcaaaccagtgatgcttggtactcctgagtcgtctctggctccgaccatgacaatgctcacttcatttgaaagccacccccagcccctgcccagtttctttaagtgacctcaccaaattctcttgagttggaaacctctctcgatgcagctcccctcacttccaattctctgtgttacttctcaccatccccattctcccctctcagaagtatatgtgctttccgtgaccctctcaactctcctatgcctcaactgcatgatccacacaccctctgacactggactccccagttctcctcctgacctgtatctttcttacttggaacttaaaggcactggccctggaggctggcagatttgagttcacatcctgactccacttcaacctgtgtgaccttagtcaagttccacgaccaatcggggcctcactttttccatctgtaaaatggggtgatgatagcgcctatctcacagggtcaatgtgaggattaagtgtggttaggcctggacagaacttggctcatagtaagtgctcagtaagtgttccctggtcttctcactgtctgaccagtgttttcttcccagtgtcctacatatgctcagattcccatctaccaaaccagcccctggtcctcttccacctcccggagagacacactctcccttgtactctcattctcagtctcgtactctaccctgtccctgtaatggaaacatccagctgctcaggagctgcttctgctgtgttacccccgagtctctcagccccttccctactggattttagccacaggactctgtagtgatgactcaaaagttatcagcggcctctgcctcatccccacacctcatgcatttcctcatggccttggatccccccattcctgatgtgctctcttggcacacatcctgggtgctcgcccacatccctggccctggtggcattccatccattcctgccctctatttctccttccccctcccaaccttatctgctctctagtctgtcccaatcgtcttaaaggcaaatgactgccctatctccagagcctacttctctcccaaagaagtccctcaatgtgcagaagactatgtgacctctccacccagctactccaatggcccctaaaacctgaatgtccaaaaccaagaccaaaaacttgctgtacctccttgccatgctttatttccctatttccagtttaactgtgcaaccatcatcccagtcatgcaaggcaaaacactcagaatcaaaatgacctctcccttttaccttgcttgctacataaaactagttactctggctggacgtggtggcccgtgcctgtaattccagcactttgggaggcctaggagggagaatcacttgaagccaggagttcaagaccaccctgggcaacatagcaaaaccccctcattacaaaaattaaaaaatattaactgggcaggatggcggatgcctgtggtcccagctactcaaaaggctgagatgggaggatcatctgagtccaggagtctgaggctgcaatgacctagggtcgtgcccctgcactacaccctgggtgacagagtgagaccctggctcaataaaaattgtttttaataaaaaaaattagttacccactctagtttcaatgacatttgacattttgacatttctgtaacatcgagttctgtcccaacagtatctgctctgaatttggactgatgtagctactttccctctctgcctccttctctcccctgttcctgccctctcagacaccactgctacgagaagagtcttcctgcagcatgattcccatcaccacacctttcccctcccctccttcctccagcacttcagtggctccctattacctgtgggataatggccaagttccttgttcttcccttcctctgtgttctcaaagctttttctcctcctttccaatcagttttcttcactgtccataaggattcacgagcattttctcttcccgctagacataagctcctcaaggacaagacctaagtcttgcccagttctgccttctctgcagtgccttggtcttgtactcactagtccctgctaagcatctactatgggctgggtgcttaggatacagtattatggcagagctagtccctgctgtcctggagcttatagtctagtgcttaaaaatgttcatccaataaatactaaaacttggccaggcgcagtggctcacacctgtaatcctagcactttgggaggctaaagtgggcagatcacttgaggtcaggagtttaagaccagcctggctaatatggcgaaaccctgtctctactaaaaatacgaaaacttagcaaggcttggtggcacatgcctgtagtcccagctactcgggaggctgaggcatgagaatcacctgaacttgtgaggcagaggttgcagtgagttgagattgtgccactgcactctagcctcggcaacagagcgagactctgtctccaaaaaaattaaaaaacaaacaaacaaacaaaaaaaacaaactaaagctagtcaattaggggaaaaataagcacaacactgaggaccaaaggtctaactttgttaaaaataaaagacgttttaaaactgtctgctaaacattcattgacatgtaaatctgaatgccagtgtctctgtctcctctcctctaccaggctgaagttcctcaagagtcattaccatggttttgtgcatgtaagccaccaatcagtactgactggataaagaaaaaatatacctaacttactttttttcatagatatctgtaaatttaaacagaggcaggcaacaggcaggggcatcctgaagaacagacattgtttctgcactgtaaaacagaagtttgattagggaacagaccatttcctccatattacaagttatataaacagagttcataaaattaacccagtgcatatgcaaaataaatttacggatttctggtatgtcagaatgtattttccagaaaaatttaaagaaaggattttagggacaaggcaatgaaagaagattacgttacacagtagaattagtatcaatcatagggttttccacaccagtggagcagaaaagcatgatgaattcagagcaaaagggagaagagcttaaatatctcctgccacactgcagtttgttagatatatgtgattggcgttcccatagataaggatacacaactgaatacaacataatctcaactacagttttaaaaaaccagaggcaccaaaaaacgctcaaagggaaaaaatccaaacaaaactaaaagaagatgccaaactgttaagtgcaattggctttgggccataggcctgtggatggttttttttcccctgcttcttttatgtttctaaactttccaaattttcttcaataagcatcatttttattctgagaacaacaacaaaaaaaaaacccgtaactcgtaatttaagtaatagtgaagtacaagttagaaaaaagatctctgatcatccaaggaaacactcaggagtgggtcctgttttgccagtctccccgaaacagggagacccaaagaagtatcacattttactatgaataaaaccatcaccagacgcttgagactgagatagtcttaaggtagacttatggggctgagtatctatttgacactaaggatatatctgcaaatggagagcttgaagatttgtagatctagtctttacacacaaatctaccttctacctaagatctcaaggtaatattttagacttttcaggcttataaacttttattgtaggggtctactatttttagaacctatttgaacatgttgcgtattattttactcccaagtgcctgtcaagtttaagctgtattccagctttgattaatgacttagacaagagtcaaatggcttgtttctaactgtatcaatctagaataagcattattccacatgcaatcatcacaagggggtgggaatgtgattgaatctatttttattatttctaaaattgtttctgggtcaaatgttatttcctgaaataaacagcttgcttgtttcttacctcagtaaagagagtgatttgctggcagccccggtggcaagtgagaccaggatctttttgctgccaattttgtatctgtggaggctattcactgcaccgatcgcatcttgtaagttttccatttgcacaacagccttgagttgataatctgtatgggggctgagctcaacactcttcacctacaacaggaaaagcgaaaactaaacgctatgtccgcccagaaccctgtcgtcttaaaactgaaggtgaaccatgaaggaacacatttgtcgactgcagcgcttccatgaaggagtatgtctgaactctgctcttctgctgaccaggacgtaagaaagtgaggatagggtgacctttagagatgtgacactggcccggcctgcctgtgtgctctggcacacacaggtttccaaggcaggctcagaggccaacacatgggaagagtgtttggggtcttttctagactctacaaaacccaggacatggccatttttaagaatctactaaaaaggtgcatttttagcaaaattgcacctaaaaaatgagtcaaatataataaggcataaacaagaccagccaacattattttagaatcctacctgtatttcagcaggaagagctaactgaaatccatcaatgttttacttatcaaattgcctttttttttttttctttctgagatggagtctcactctgtctcccaggccagagagcagtggcgtcatctcagcttactgcaacctctgcctcccgtgtttaagcaattctcctgccttagcctcctaaggagctgggactacaggcgtgcaccaccacgcccggctaatttttttttagtagagacggggtttcactcgccaggctggtctcaaactcctgacctcaggtgatctggccgccttggcctcccaaagtgctggaattacaggcatgagccgccatgcctggccacaaattgccatttcaatttctgcctaagacaagagcttttcactgctaggcgtcttgctctctggggctaacattgtaaaaactggatttatagcaccaccctgagcagaccaaagggaaaaggaaggagttcaaacttgttcagtcacacttctatcccggctgtggttatgtatatcaaattaggtcctcttgactagagactccatcagagagtataacaaagcaagcacaagagggaaaaagttaccttgccatgcctggcaaatgcttcctgcaggagctgctgcagctccttccgggataatctgtagtctatgttgctgacttggacatcagcaccatttgcaaatgggtctgggcagtcggcttcgctgctcgaatttgcaatgttgaaagcaagcggggatgctctgtttaaaaggtttggagacatactcctgcttaaaacacacatattgacattattttaaaaaactgttctgtatatttagattttatcatttaggctttgtttgaaactatatacagaagcagattttccacaacacaaccaaaccaaacatttggttttcaaatgtgtttttaatctttttttttttttttttttttttgagacagagtctcgctctgtcacccaggctggagtgcaatggcacgatctcggcttactgcaacctccacctcctggattcaagcaattctcctgtctcagcctccccagtagctgggactacaggcatgcaccactacacccagctaattttttttatttttggtagagatggggttttaccatgttggccaggctggtcttaaactcctgacctcaagtgatccacctgcctcagcctcccaaagggctgggattacaggcgtgagccactgtgcccagctgtgtttttaatcttaaatacacattgatttcagacattgtcaaaagtactatctactgacccctaattaccgccaaccaattaatatatattcttcctttgggttaaagctaaaggcaggaattagaggcagtcctgatgaattaaccttctgctttgtgcattatccttaggaaatcagcctgtgataccaatttaaggcgtctaacctcctctgtgtctctgaaagagttaaacgttcttgcctacatgttacagttctttctgcacataaggaaaacttttatgtggctttttagatgtaattttatagatccatagtcactttctctttttttttttttttttttgagacggagtctcgctctgtcacccaggctggagtgcagtcatgcgatctgagctcactgcaacctccacctcccaggttcatgccattctcctgcctcagcctcccaagtaactgggactgcaggcactcactaccacgcccggctaattttttgtatttttagtagagatggggtttcaccgtgttagccggttagccaggatggtcttgatctcctaacctcatgatcctcccgcctcggcctcccaaagtgctgggattacaggcgtgagccaccacgcccggctgatccatagtcactttctacagtgatctgccaccaactcagcagaacaaacacaatgctaaaaggagctcatgggaatgcaacacggccttacggcttctctgtctcccaagcatcaagaattccttggtgtgagagacagtgataaataattaccatggtttacagaaaactttacttccaaatagcttcctatacagaaccatatgaatcagaaccaccaatgcacggctcgtttgggctttttcctcaacacagcgaacatagggacatctttacatgcccccctgcactggccagggactctccaacaggcttctctttctgacctctgcttaccacaatttccagatggaggaagaagaaatggtgaaagcattgcccctaaatgttaacgatgattacctgaggagagggggactggcagaagagtgatgggagacttactttgtgcatttcagtactatctgaattcttttcaacaaacatactatttcataatccttcctattacatgtaaccacccccatgggtcaagaagctggactcacctagaagaccaagactgagatgcgagcagaggactgacttgcctggatgcaactaacttgctaaaagcagacgggtaactcacttggaatacagtctcctctttatcttttttctctacaggagaactggtaacacttcgggcactgaggttctcctttctaacagaaggggaaaattgaaggcaaaaggtcatatgtcttccttcacattcaagaagcagctatgagaaagagtagtttcacatacttctgactggttttgtaaacgggttctgccacccccgagtttttcggcgtcgacactgcagcacttgagttaccgtgagtgggtacgaccagcctcaggtgaccttgctggtgctcactgtttctatgaccagtttttgactccatgcggcacagctccttcaaagacacaagcacagtggggtttaaattttaagtacccaagatgtgttagatcctttacagaaaacgattgactttgagtatcatcaaacactgaaatcaaaaagggacacgccaaaagcaagcgggcacgtaaaacacagaaacaaaccaaacctaccataaacttcagaaagcaagaggtatcaaaattacctgtaaacttttaacatttgtattttttgtagcagatccagaatttgcctgtgacccttttccaggcgtggctttggcactggaagattgttcacttgcatctttgatgaggcacaattttggattcttaagttttttgggagacttcactttatcagcaattgcatttgaactctttgtttcacagagttctctattttttggagtaaatgacacaatgatcctattaccaaagacatcttcgttttccattcgcttctgagcgcgctctgcactatcttggtttatgaagcggagaattgcactgcagcctgtgatactcagcactttcccaccacaattatcggacaggcgtctgagcctgttgctgacgctcttgccatccttatttgctggtaggttataaacatagagcagagtgtggcactgctaatacagaggaaagaagtgttacgtcaggttaattcaagggcacacattcaatttcaaaataagaacaatgggtgacctccaaacttcagttaacaactttgaagagaagatgacagtgatttagatgggagagggtaaattatttagtgttgacaaagtaactgaatattgttttaaagaatatgctttagctgggcatggtggtgcatgcctacagtcccagctactcaggtgggaggattacctgagcccaggaagattgaggctggagtgactgtgccactgcactccactctgagtgacagagtgagacactgtctcaaaaaataaaaataaaaaagaatatgctaggcacagaggtctgtatactatatgattccatttctataaagcatccagaaaatacaaatctacagagacagaaagattagtagtgcctgggagtggggaaggggattaattataaattagcataatagatttactgaggtgacaaaaatattctaaaattgtacaactcaatttactaaaaattattgtacacttaaaagagctgaattttgtaatatgtaaatcatatctcaacgaagttgttttttaaaagtctatttattctgcaggtctgctgaataataacttatagagccagaaggtgagcagggtcagtcctggttggtttttgcataggagaatgcctgggaatactaggagctataggcttaagtaaacaaaaatttttttaaaacccaacaatttagagcctgttcagcttcaacagcagattgccagtagttaggctggaagttttatttggcagtgggtagtcataattcttccagataagttgaaatttatgtattaagaagtagaacttggcctggcacagtggctcacgcctgtcatcgcaacactctgggaggccaaggcaggtggatcacctgaggtcaagagttggcgaccagcctgaccaacatggtgaaaccccatctctactaaaaatacaaaaaaagttagctgagcaaagtggcagacgcctgtaatcccagctactccagaggctgaggcagaataatttgcctgaacccaggaggcggaggttgcagtgagctgagatggcaccactgtactccagcctgggcgacagagcgagattctgtgaaaaaaaaaaaaaaaagaaagaaagaaagaaggaagtagaactggagaaaaagaaagaaaagagagagagagagagaaagaacgaacaaacgaacgaacgaacgaactggccaggcatggtggctcatgcctgtaatcccagcactttgggaggccgaggcggggggatcacttgagcccaggagttcaaaaccagcctgagcaacacagtgagaccccatctctattaaaaatttttaaaaattgccaggcattgtggctcactcctctaatcccagtacttagggatgctggggcaggtggatcacttgaggtcaggagttcaagaccagcctggccaacatggtgaaacctcgtctacaaaaaactagccagaggctgggcacggtggctcacgcctgtaatcccagcactttgcgaggccaaagcgggtgatcacctgaggtcagaagttcgaggcaagcctggccaacacagtgaaaccccctctctactaaaaatacaaaattagccaggcgtggtggcgggcgcctgtaatcccagctactcgggaggctgaggaaggagaatcaattgaacccggcaggtggagtctgcagtaagcggagatcacgccactgcactctagcctgggtgacagagtctcaaaaaaattttttttaaataagaataatattttaaaaagcagaaccattaaagcaccaggagaaaacttaagataattatataaagggttaaatccagaaaccataagagaaatcactaacaacaggcaaaggatgtgaacaatttacagaagaaataaaaagcaaacaacgataatcataaaaggatattttgcactgtgttaaagattaaaagtcaattataagatgatgctgtttttcacttactggcctggcaaacatttaaaacagacactcttatgagtgtaaattagtaccaccttcctggaggaagacatggatcttgctagtaaagttctaacccagaactcttatgccttggaaattaccctatggtatgtcagcccaggagcctaaagatataaattaccttgctggaaatggtaaaaaacaaaacaaaacacaaaactgggtataaacaaaatgtccactaacaggtagactggttaaataaagaccagccatacaagtacttttcaaaccaaagttctggtttttaaaatgtggcagatttatattaatatatattaacatgaaaagacatccaagctctgacatagtttttttccaaaagccacagaacactgtatatgtgacacatttttttttaaacgtacattttttaaatctggagggcaataccaaaatattaacagtggttacttctggagggtagaattgtggggttttcactttccacatttctaaatattgtgttttgtttgtttttacaatgatcataccatactattcttttctttcttttttttttagattttttgagacacagtctactctgtcacccaggctggagtgcagtggtgtgatctcggcttactgcaacctccactttcaggttcaagtgattctcctgtctcagcctcccaagcagctaggactaccagtgcccgccaccacacctggctaatttttgtatttttagtagagatggggtttcgccacatcggccaggctggtctcgaactcctgaccttaggtgattggtgatctgcccacctcagcttcccaaagtactgggattgcaggcgtgagccacatcactcggcccacaccatacttttctaatcagaggcttttctttttatttgaggggtactgaccaattatcaacaaaatctacacttttcctattacacctgggactcaaaacccaggcagtaccaatgtatgtttaatttattaaaattaaaggaacagactaaagaacataaaaagaaatgtatcttaaattatcactctagtggatgggaaaaaacatccagcaaaactaaatggtttgaattatcaaaacattgttttggtttttttaaccataaggaataagaatctccaaagtgggcaagttcttacctaaaacactacatttacttttttttttttttttgaaacagagtctcgctctgtcgaccaggctggagtgcagtggcgcgatctcagctcactgcaaccttcacctcccaggaaaaaacaccgtatttacataaggccttcaaagttagaaaagtgaccgtcaaacagaagcagaagggaagaaatgtaactacagccaagtgactaaaaacaaataatgacaaaggtgagttaggaaagagcctcaaaagattaaggtaaggcctgtatatgcttactccctgggtaagcctctggtatccacaactctcaactgtccatagcatgagtttcaacttaagccagaccgcagggggcttgttgggtatcggggacacaggtgactagcaggcaagtgccggaatcaggatacccggggcccactctcttaactgctgcaatcaccaatgacacgtttactttttctaagagctgatttctttctcccttaaatgaagactttgcatgagatcatgtctaacgtacttctgtaactctcagttattaaattatatgtgaagactttcatttaacgtatgggattgcccactctcctggatcacccacaccatggctccttctccattatcattaattctttcagagttacacacatattcgccagcggcttaaacacagcccagcactgcaataaacattcttatcccaagtcaagtctatcagaaatgctagtcctggaaatgtgctcacaccctcctcccagtatatggcataaacaggctacacacaggtggagcaataaccactcctgctaattgtgtccatgcaccacagggaatgcacaatagaaagcacagactcagaggcccgctgaagcttaaggattaaataccgaaaaaaatgcacaattgactccacttatttggtgccaaccacacaagtatgtgagaaccctcgccatattctctacccataatacttggaagcaaaaagaatcatgacttttaatccgttatttctatccacctgacacaaaacactgctagctttgaagacactggcaagttgggaaggtaaatctacaagtcaatttcatatgatattttgaaataaataaaagcaaacttcatacataccaattatctgtatatttgtgagaagaaccgaaggtttctaagccttacttcaaaatctaacccacctcttacaaagaacagccccatctgggcctggcaacccccttattatgggctgtctttcagcctccacaatgtaatattggaaaatggcaaaaataacgcaaacccacttactggcatttttagtggtaacctggggggcaagtcggaaatgaactcttcaaatctgatcagctcgttagcatgatgcagcagtgcttctgaggcctggtttttatggaccaaaataatgtggaaaccatgcctgtgtctcaggtcactaagttccaatgcaaaattgacatcagctgaaagaaaaggtacagaccaaccccatccccaaacattagaaacacttgacaaagacagacaactctattgacacccactgagaagaaaggaaaggctggactatattcaaaattgcttcccccgtttcttaggaaagaaacacgtttcacatcagaagaatgtaagacaatcttaccaaaagaattccaagacacatatgttactttcagtattaaaaaggagcaaatatgttggggagactcaaatttgaaaattaacttaaactttaaaaattattaatactgagcacaaggtaaaaaaaaaaaaaaaaatcacatttttctttaataaacctggtcccggccgggcgtggtggttcacgcctgtaatcccagcactttgggaggccgaggagggtggatcacctgaggtcaggagtttgagaccagcctgaccaactggagaaacccccatctctactaaaaatacaaaattagctgggcgtggtggaacatgcctgtaatcctagctacttgggaggctgaggcagaagaatcacttcaacctgggaggcggaggttgcagtgagccgagattgcgccatcgcactccagcctgggcaacaaaagcgaaactccatctcaaaataaataaacaaaaaaataaaataaaaaataaacctggtcccacaataactcaagttccaaggaggaaatacagaaatccacctagacccaattttttttctaaacagttctcaacaataaccataaacatgtctcatgtacttcagcctctttggggatacattttactttcacatgttgctggcttctatgataatttcccacacagtgagtttagctgaaattagcagatgtttctgtacttacttgacacaagaaccactgtggctggagcagtgtgtgtatttgcaaatctgcggagactctgccgcagtttatcatcagcggcattctttgcagtagcattgatgtgggcaacggttacctgcattaatttataataagggtgaataagcaggagctgaggctagaaaattgctacacattctgcccatattttttattttttaaattttattatactttaagttctggggtacatgtgcagaacgtgcaggtttgttacataggtatacatgtgccgtggtggtttgctgcacctatcaacccatcatctaggttttatgcccccacatgtattaggtatttgttctaatgctcttcctccccttcccccaaccccgacagacagaccccagtgtgtgtttttcccctccctgtgtccatgtgttctcactgttcaactcccacttataaggcaagaacatgcactgtttggttttctgttcctacattagtttgctgagaataatgacttccagcttcatccatgtccctgcaaaggacattatctcattcttttttatggctgcatagtattccatcgtgtattatgtgccacattttctttatccagtctatcactgatgtctgcccatattttaataagtaattcttgagaaaaaaattcttattactattgggaatggtaaaaaattacaacagatctcagtaatctcaacattggttcttgatatgaactgggtttgtgactaaccctgctctcatctccaatcttctgtttttgcatttctttcatcctcctttcagaaaataagtagaatataggaagtgaaatttgaactcagttaaatttgctctaatagcttctgccaacaatttggaggtggtaaagatcagacaaatgactaaaataagatttaaggctgtgttttatgtcaactgtccatgctacccatgcaagcttgtgcaatctgccttttgttgttgttttctgttttgttttgttttgggcttttagcagctggaagccatagtttttagtttccgtccctactaataagcagaaaagagagataaggaaggtgctttactagcccaaccagaaacagaaactgagaatccatgattgtattctctcccttggacacccctggatggctttcaggatctggggtgaggtggtagagagaggagggaggatatcccctaagggagctaaaatgcatttatttctgttaaaactatcaggctcgcatataagtccccaaaggaaggaaaggtttattttgagaaagttgcctcaggcacctgcaatacacaataataacttgctggtttttgtaaagaacatgggtatatcattttagacaagcaatatggactatcaatataattaattatctaagagtcaaaagacccaaattctagtttcagcttaaaagcagactctgggggtcagacaaatctagatttggatctttgctcttcctggccaagtgatcttaaacaagtttcttcacctctcagggccttagtttaatttgtaaattgtgaattatatattctacgtgcctggttcaaagagcagtaatgaaaatcaaaggaaataatacatatataaccattataccagtatagaactaaaatataaattagggagcataactgaaagaatgattaaattatttctagtactttggaagtgatcttttgctaatttattttatttgaaaacttggcacaaatgcaatatcattaaacaaattttcaatcagaattctaaaaaaaaaaaaaacaccacacacacacacacacacacacacacacacgtacagcacttttagaggccaaggcaagaggactgcttgatcccaggagtttgagacaagcctccaccacctaaccctggatcctgaaagccatccaggggtgtccaagggacagaatacagtcatgggttcttagtttctgtttctggttggaacatagggagacctcgtctctacaaaaaataaaaaatgagccgagcatgatggcgtgcatctgtgatcctggctagttgggaggctgaggtgggaggatcactggggtcccagggttcgaggctgcagggagccatgaatgcgtcactgcactccagcctgggtgacacttagactctgtctcaaaacaaacaaacaaacaaatatctgcttattcctctactgtagattaaaattattaaattttttttttttacctggcaattattcagctcttgaataacttccttgttttctttactgatgtcacatacacagatgaattctgcttctctgtggcctttaaaaaacttctcacggattctttgcacaacagcagttgctgaccggccagagggaacggagcagttttcaatatcccaaaaaactccaatggggggtaagttttctagcacctgtccagctactgcaacttctggtgacccttaagaaatgttaacattttcaattacttgtagtggaaaataaatggcaagttacaataagataataaactacctatcattctcagtggtagaaaaactaaattattaatgaatgccaagttttaaggctaccaacctcactggttgacctaataagcaatcaagctgtcaaaaagtatcactctaagagattatttctgtttttcaggagaagacaaatctaaaagtcaagtaactttaagcccacaataaatccacctccaagcatgagccactctgacattaagcagtgatgcttctctgaacacaagcacactaactgaccggatactgcagctccaggacccgactttcaagcttagcccacacttatctacctacttggtagtaaccaacactgaggagctgacaaagggtgaagctgttactgtcgttgattttgagttaacgctgcattaacatctgatttaatattttaaaaatgttttcaaaacgtcgcattaactactttttagggaaattattttaactgagaactctttggttttcaaatactgtttttaatcagccattagtaaattgttctaagcacttctagggagtataccatcaacaagtgtgatttccaacctaaggtgacaccaagtcttttccagcacttttatttctcctgatatactaccaatttttctatacacagcttctgtgtatagcctcggcccaacataaagggcaaatgacttcctggtccataataataaaaagatttctaccaagatatggaattggagactcacatacacagtagctttagaaccataaggaatccttcaaaggtgattaaatgcaatgttagtatgagatattgaaagctatttaaatatgcacattttatgccatactgtcatttaccaaattttgaagcagctttgcctagactggtcgccaataacaacgtggtctccttccctgttcctttggttccacagccattacacagagggacagcaagaggtgcaggttgagtatttggaggtggtatatttggccagactttagccgcatcgattatgctatttcttgctggctgttttaaattttttttaaaaaggaggaggtgtcagatacatcatttcagaagctggagttatatacaacaactgaaaatacactctaagtgttttacctttccacttgctagcctctaataaaaaggactttcaaataatctttccaagaaccattagctatcagttcataaattcatttccagaagtgacttgacatgatcaagaaagatattcacgtggtcagatctttacattctggggcatgagtctgctgcaacgaagacctcacacatattttacataaagggtagcaaagtctcacttgaacaccaatgtgactgaggccaagcttcaggtttcccacattattgcaaaaagacaacatgcagttatctaccttacatgaatgggcccatgtgtaagctgaatgtaagttataaaaaatccatcgtgctttagcctttaaacatagaacacgaaggctttgccaacctcttgtttgcaacaagaggctctaaaagtataaactacaaaaataatgactctctacttttttgaatgatctcccatcttaccctttgtttctttcagaaccagcaaaaattatgctgatggggagattcccctataccatgggagaatcttcaaccccatgtataatacttttcaagataaatccacttcaaaagtcattcctcaatcctcagctgcacccaacttaagaaataaaaagatacgaaccttgtttagacagtcttcgcagtaaagtgagccctttaaacaaaccggaggtaccacattaaggtgcaaagagttggtgcacaagtgaggcgttagctccgactgtgaaatgtgctcttccaaatgccctggagccccgcttgtgaaatcagaacaggggaaatagccagcggaggtgcagccctgcagactcggaaactgatgcagcttgtgcacattaccatgacatgactggaagtggagttttccacaacagggcaggtgtttgcaggaagacaggttactctctagacacatgctgggaaagtcacttgcaatgcctgccaaattgttcctagctgaggcattctggagtgaagatgcagactggaaagcaaaccctgaccctacctgacacgtgattgtcctggtgctttgcgagtctaacagtgcgcccgggtgaatcaagctactggtacctccgctaccgccaccaccaccaccaaaacgcattggcgaagtggagggttcattagggcaatgagcacagcagcttactttggggacagaagaaagctgtattttaggctgctgaagagaacgaatatcaggaagtgggactgctggaaaaagcttagagccagcatgaaggggtgatggtacatcctttagttccacagcaactttcttgttctccatgtactctttctgagaaaagaaaatcagaacataaattaattttatgaggtccgtggttttttggttactcatatcttactgcatgcacaaacagaaatagtgttcaattctgttacatcactaaatcataactgaacaaaatggaatcacagctagttaaaaccaggaacattcttcagagaggtctgcaggacatgaacactggaacacacaactaaaattaagactacattcttcctgaattgaaacagactggggtgggagggcctgtttacatctttagcagccaccatgcctcagtaacttccttttggtaatttccccttgcctcacagaatcttctgaagacaaaataggtggtatgaaaacaacccctcacaaacagcattcaataaagatggctaacacacacagtggtttgaggacaatacttaatagttctgtggtcaggccataaggggttttagtaagatcccccaaaggaaaagagtaaagtttcaaacacagatgagatcagccatctacccagatggcccatccgtgttgctgatgacatttcataaaccctaagatatcatgacctaaagccataatgacaattatattgcagccagtgaaaagatttagagaattagaaaactatccaagaaaaagatccaagacaaatagtttgccacatgactccaacacagacacaggaagccagtatattacaaaggttctgagcagagcatcagtggcagagacctgggttagaatctgatactcaatagttgtatgaccttgggtaagttacttaacctacactttggtttcctcatccataaactgggaatacaatatacctcctagagttgctaggaggataaaataagatagagcacatagaccacctggcacagtacctagccactgaaaggggactgaattcatcagccttcacaggctgactgcaagagacattaagatgaagagggggccctgctacagtgactgagacgtgctcaccgttcacagcatatgagggtccatctgacgcctaaaattccactccctttgctgtgattctacactcacctgggagcataggctcatctggaagaaatgtgaattttcagctaaactttccctaaaagggagataacagcaacgggctgaccagccaatgaactgccctcttggtaattatagttcagactgaaattaacacactggtattctgatttatacagatcaggctcatacaggcaggcttactatgagttgatcccctgaacctactccattctgcatgccactgacaaaattgagtttcaagatctgtaaagttgaccgtgtaattctgaattgtgtgactccatgaggaccagatctaccaccccatcccaggaagccttgcttttgatgccaaccctcactgtcaactgtctctaaaataaaacactcctaaaatgacccaaattacttgatgtcttgcaacaaagacaactatatagtgaaaacctagagaaaatagagaattaaactggtttttaaaaagttattaatacccggccaggcgcggtggctcacgcctgtaatcctagcacttgggaggccgaggcgggtggatcacctaaggtcagaagttcaagaccagcctggccaacacggtgaaaccccatctctactaaaatacaaaaattagccaggcataatggcgagtgcctgtaaacccagctactagggaggctgagacgggagaatcccttgaactagggacagtggttgcagtgaacccggatcgtgccactgcactccagcctagggggctgagccgagactctgtctcaaaaaataaaatcaaataaaagttgttaatacccttatataaaattatattacagtctcacttgaatcccacatacaatagaaaataagaaatagaaaggtggtaacatgagtgcatgaagtcaggaaatgtcaaaattggctggacgcggtggctcacgcctgtaatcccagcactttgggaggctgaggcgggaggatcacttgaggtcaggaggtcaagaccagcctggccaacatggcgaaacctcgtctccactaaaaatacaaaaattagccaggcatggcagcacaggcctgtaatcccagctactgaggaggctgaggcaggagaactgcttaaacctgggaggcagaggttgcaatgagccgagatcgcaccactgcactccagcctgggccacagagcaagactgcacctcaaaaaaaaaaaagaaaatgtcaaaatcacaatgagtaagcaagaagttagagacataaatgtatactgagaagtaaatattcaagagaaatctcgaaataaaaaacaggcagtggataagctcttcccaacccttcctagattatagactcaaaactcaagagggctacagtaaaatacaacatattttgtattttcctctgattttactccacaatgtggatttttaatctttgttacctgtgactttaatgaggaagaaatctttcccaaattttaacattaaatattcaaggcatctactgttactcaaagtgaaatagaagagttaaaaaattgtgctgtgctctcacattataatgtggtataagaggcaatacaggcaagatctacagaaaaatgtggcacagactctaggatgagagactgtatcccagaccaaatggacctctctcatctatttggatgaggaatctgctacatccttagtcttgcatatagttaccgtttggggactatgtggcagcgtctgctcaggacgagaaaagcaattagagaatttccaaagccatggcttagcatcattatcttgttgaagccatccacgtgttctactgcaggagttctcagttccgtttccttccatcatacagccatgcaaagtgattcaacatcctttcatctttcttttctttcattcttccaccctgttaagaatgagtaagatttcagtgttatttccttgcataagtacaaattttacaacatactaaaatgtgaaaccacagctatatttacagtcctatggctctcaacaattcaaatctttgtttcaagaggaagtctcgctctgtcgcccaggctggcatgcagtggtacgatctcagctcactgcaacctccgtctcccgggttcaagcgatttttctgcctcagcctccagagtagctgggactacaggagcctgtcactatgcctggctaatttttatatttttagtagagatggggtttcaccaagttggccaggctggtcttgaactcctgacctcaagtgatccaccctcctcggcctcccaaagtgctgggattacaggcattagccactgcgcccggccaacaattcaaatcttaacaaacaaaataataataataaaataaagaaagaaaaaaacacaaaatatcagagcatattacgggttaataaaatttggtaaacttggttgactgtttatgcttaaaatctaactgcaacaacctgatttcttaaaaaatctataatctgccattcttcatgtttcatagctcttcaaataaaaaatgaactctccatgagtcttgtttcctttccacatgtaaccatgtttgagagaggtagccatatcttggaaacttgcatattccagagtgagacttcacctcctcacttggctggaatcaattttttctacagtttttctgaattcttttcggctctctctccctaaagatgctgctcaggaaagtcaaaagttaacagaagagagcatctaatctgagtaaaagagccaccaccacatcctcattgacaactatatgtaagattttaaaattgacttaagagcaacttcttgcactggtttcttgatctgagcatgaaaagtccaaactaagtggcctctgtggactttgaatttgatttgctacagaacaaattgaaccaatttcttagtttactaatgatgaaagtgcaatctgatataccaccaaaaatctaactgatagaaaaatctcaagtcgcagatgtgttatatctacgccagagcaacaacactcttacaggtcttaacaataaatgcaagcgaggcaccgtggctcaggcctgcaatcccagcactttgggaggccaaggtgggtggattgcttgagcccaggagttcccaaccagcctgggcaacatggcaaaaccccatggctacaaaaaattagctgagcgtggtggtgcatgcctgtagccccatctactcaggaggctatggtggaagaatcacctaagactgcgtagtcaaggctgcagtgagctgtgattgcaccactgcactgcagcctgggcgacggagtgagaccctgtctcaaaaaccaacaaacaaaattacatgaaattaaaatgtcagtgtccataaataaagtttaattgggacacagacacactcattcacttaaatactgcctatgactgcttttgcattccaattgcagagttgcaaagagagtctctgcaaagagactgtatggcccacaaagcctatatttactacgtggctcttttgtcagcctgggcaatatagcaagatcacagctctaaaataaaataaagttcaaaaaattagcatagtgtggcagcatgcgcctagtcccagctactagagagactgaggtaggaggatctcttgagcccaagaatttgaggctacagtgaactatattgtgccactggcccttcagcgtgggcaacagagtgagattccatctctaaaaaaatttttgttttcaagtttctgtttcctcctatgcaaaatgtggctaatttctccccgccactgcattacagagaaaaaaaaaattagataaatgaaccccactgtctattttcaccactgtatctcttgtgccaaccaaaatgctccctactctgtaaatacaaagtaaacattacctactacacactattgggagtggttaatttggagatggatttaactgctaccactgatagtaaattacgattcttgtctttcctattagatacaggttttatgtcccccaaaaaactcctctcaaaatcgtaagaatctgtgatattcacagtgttcataacttaaacattctctcaaacttcttcaaagccaaatcctgaaagtgagctaacattcacagtataatctagtttataaagtattttcacttaacattacttatgtcttcattcagcaaatatttacttagtatctactatgcagcaggcctgtgcttggcacaaggaatataatgatgaaaaaaacccagacggtgggatcctcttatataatttttgcaataatcctgtgaaatagacaggggagaaattagctacatttttgcagagagagaaaaagaaacttaatgaagttttgtagcgagcctgacacaagattaggcttgttcacccctttccactacatcaaggtgccttcaatactgctcaatacaagcgattaaaagtaaaaactttcaggtgcctgcaccctgaaaacttcccaaataccatccacgaagcaacttaggtagccaaaagcaggttctgtttgacttgagcgacagtctcctttctgtcactctcttcaagtcttttgaccaattcaatgaggagagcataggctctgtcgactgtctgcattttggtctccaatttgactgcggtgcagctttggacaactcacaacctctctgaacctcagatcccatctctaaaatgggtgtgataataatagaaaccaccttacaaggccgttgtttggattacatgaggtaatccacggggaacatttagcaaatgttgtttccttagcacccaatctagtctttgaccccacaccaccccatcccattaccgttttctcccccatagctcttctgtccaaaacggcctttttagcttattttattatctttctcccccattaggctataaactccatgacagcagagactatgttttcttatccactattccaactcctgtccttagtacaatgcctggcatattttaataaataactgttgaacgaataaagcttaataaataggaaaacagtttaggtttcaatacaccgatatgcaaaagagaagaatatttaccgctcagagaagtccaaaagacacaaatgcaattggacagctcttggtaataccggaaaggtgcttgagaaactctaaaaggtgtatcacgaggtcgcgttacaactactagtgagagtggctgaagccctagacattgtcaaccctgagactacaccctatgtgttgctaaaaggccgaggagaatgcaaaacggccggggaggggggagtgtgttgcaaaaacacccgcccctttccttctctcttaaccttccagctgtgcacttcactcctggagggccccaccaggggtcagacaggggcgggcggggagccaaatgccctcgaaggggaacagcggcgccaacagtgacagtagtgaatggacccgaaagggagacaagccaactctttcgtggggggcccaactggcgcgtcccagttagctaacctcccctctccaccaccatcccaccagcaataggcggggaaagaggggacactgtcctccgtcccgccccgctggcctcggagcagagcctgccggggtctggtcgcaggactgtctgcaaactcacctctgccgccggctccacctccgctcacattccggccccgccgccttccccccgccccccccaggccctttgttttgattcccgactccgcagctcccgccgccgccgccaagcgcacccttcacttccgcttccgcaccgcaccgcccctgtcgcaaaaccgacgcccttctctcctcttcgccccgccccttcctcgccccgcctccgccgccgcgtcctgtccgcgcggggcatgctgggaaccccggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacggttagtttcaaacactttgtgttttaggtggccagatatgctgtgtggtttgctttaaaaaaaaaaatagcgccccacaatcttcacgtttccctggaataaaaaaaaatttaagactcagcaaaagggtgatttctgaaactaccagctgattactattttctgttgcaaattaggaaaaaagcaaagcacatattgtgtaagttaaatctagacacgatttaggatgtgctagctgctagctaaatgctaccttaggagtttatttttaaagtttgcccagaaacaagttgactttgcaaaagaatcagtaagtcgaaattgccaaacgagaatattttgcccaaaaaaatccttactgggaggttatttcaataggcaatccccattacgtggggattaacacatccctgtaaacatccctgtagacgggtattgtggagggcaggatcagacatgtagctgaagaatcctttgtgcctgtatttaattttccagaaggcagatgacaagcacacatcctctccctgcgtaggtatttattactgctgactaaatcttgactgtgggctgggcgcagtggctcaggcctgtattcccaatactttgagaggctacggagggaggatctcttgagcctacaaatttgagactagactgggaaacggtgaaaccctatcactatttagaaaagaaagaaaaagaaaaaaatcttcattatgtctgtgtataggtagtattttccaagtggagattagaatagatgaaaaacccgtttctagcgttttggcttttttcaaagtaccaaacaaatacgctactcttcagaggtgttttttccccattttatttcagttgagtatgtttcaacacaagccatattaactaaaaatcttaagaaacaaggtaattgtaggtttctaattgctttttttaaaaaatagtttttagccagaaaacatcaaagaatgcagacacatttcctttttactttttttttttttttttttgagacaaagtcttgcttcattgcccaggctggagtgcagtggcaggatcttggctcactgcagcctccacctcccgggttcaaccgattctcatgcctcagcctcctgagtagctaggattacaggcgcccaccaccatgcctggctaatttttgtgtttttagtagagacgggatattgccatgttggccaggctggtctcgaactcctagcctcaagtgatcctcccgcctcggcctctttaggattacagggctgagccaacgagcttgaccacattttctttatatgtatatttttcttttagattcctttttaccaagcagacacattttgtttgacttagcttggcattctttcaagtccaaagctgtaactagtcacaacaagtaaatgtagtgattgaaaatgggcggggcatggtgactcatgtcgtaatcccagcactttgggaggctgagacaggaggaccccttgaggcttggtgtttaaaaccagcctgagcaacatggtgtgacacttgtctctattaaaaaaatttttaaaaacaaaacagtcgtattaagtggaaggctaataaaagtctgaattacaaatacttttaaaagaaatgtaattttattgctgctttctaaagactaggagcctaagcaaagtataccaggccttaggagacaattatgaatcaaaatacataaattttctcttaagatatattttaagtatgtatcctctattaattgtattcctgtttctttgctgggaaaactttagagagtacaagtaactttcagtttttcccttgtccaaattatagtcttcacatgtatgaaaaccgaaagacttttttgtgtgctatttaagtagctactttacatgcaattcagcttttcaactaaccaagctgttattaaaggagtttctccccagaaaccaatcttctacctgtattaggttcagtggtttgaattaataaatgatcatggaaggacctaaggaagttaaattgagttatctgctcagccatagtccaaagctacaaggaaaacaaattgaatttaaaaagaacaagaaaaacattttaaatgtttttaaggttttacccaatgacaaacctatttccctaaatgttgttcccaaataggactttaaggattattatttcaatgccctctcttttttctttatggaaaatttgggaaattgagaaccaactagtttaaataccttgatcaaagccatttaggcaacaccagtacctcatcagtttgtgcttcggtttctctgtaagctgaggtgattagttcctgtccagaaacgtcacagagtggttagggccaaataaaattccgaggggggccaggcgcagtggctcacgcctgtaatcccagcactttgggaggccgaggcaggtggatcacttgaggtcaggagttcgagaccagcctggccaaaccaacatggtgaaaccctgtgtctactaaaactacaaaattagctggacgtggtggtgcacacctgaaatcccagctactcaggaatctgaggcaggagaatcgcttgaacccaggaggaagaggttgcggtgagccgagatcgtgccactgcactccagcctgggcaacagaacgagactccgtcaaaaaaaagaaaaaaaaaatccaaggggggttaataccagctacttggtaggctgaggcaggagaatcgcttgaactggaaggtggaggttacaatgagccgagatcgcaccactgcactctagcctgggcgacagagtgagattccatcttaatgaataagtaaataagtaataaaattcctaaggggaggcttggtgtggtggctcatgcctgtaatcccagcacttttggaggctgaggcgggtggagcacttgaggtcaggagttcaaaaccagcctggccaacatggtgaaaccctgcctctactaaaatagaaaaattaggtgggcatggtggtgaacacctgtaatcccagctagtcgaaaggctgaggcaggagaatcgcttgaacccgggaggtggaggttgcagtgagccgagattgcagcactgcactctagcctgggcaacagagtgaaactctgtctcgaaataaaataaaattccaagggggaaggcatcagacgtagtaaagtgtgaagcagcatgtaaatgattcattaatgtttgggaagtttcctgaaagacatttggtactttccttaaacctgttgataggtggtggggttcccctttgtgcctctaagcagtttttaggaattagcaaggagttcaaagtagaatttgagaaaggctgttgtaggatagcaggaaggcaagatggggtgggagatcctgtaatagctaagatctctttgcctctagcatagtgctgaagaaggagggtttaggagtcagagccagctctgaagcctgatttgttaattactagttgtaagacctcggacaactcaattaacttcctgcacctttattttcttatctttaacatggatacaatttaatgctttcctgtggttcatcacctgtggttcagttgcatggtctcctctctacagtggccttccctgactatagcatctgaagtgacccctcccagcccgttgtatcaaatgggcttgccttagtcatagcacttatcagtatctgaaatgacgttactttttctgcttatagatttagtatgtttctctcttaacaatataagccctttgaggacaggtactttgtctgactgtattcactgtgctgtaagggtgcattgtacagaagaatgctcataatgccgggtgctgtggttcatgcctataatcccagcactttgggagggaggctgaggcaggaggatcacttgagcccaggagttcaagaccagcctgggcaacatagtgagatccacgtctctacaaaaaaatgtaaaaattagctgggcgtgttggtgcacacctgtggtcctagctactccggaggatgaggtgggaggatcacttgagcctgggaggtccaggatgcagtgagctttgattatgccactgcactccagcctatgtcacagggtgagactctgtctcacaaaaaaaaaaaaaagctggataataatatatatatttttagtttttatgggtacactgtaggtgtttatatttatggggtacatgagatattttgataacaggcatgcaatgcatcataatcacatcagggtaaatgggtgtccatgacctcaagcatttatcctttctttgtgttacaagcactccaattatactcctttagttattttaaaatgtacaatacattgttgtggactgtagtcaccctgctgtgctcccaaatactagatcttattcattctaactctatttttgtacccactaaccagaatgttcggtatttgttaatgaacatgttatgacaggatgttttagaagaaaataaagaaaaaaagaaattccagccaagcatggtggcttgattttatttatttatttattttgagatgaagtctccctctgtctcccaggctggaatgcagtggcgtgatctccactcaccgcaacctctgccttctgagttacatggctcacgcctgtaatcccagcactttgggagactgaggtgtattgcttgaggtcaggagttcgagaccagcctggccaacacagtgaaaccgtgtctctactaaaaatacaaaaaattagctgggcgtaatggtgggcgcctgtaatcccagctactagggagactaagacaagaaaatcgcttgaatctgggaggcagaggttgcagtgagccgagatcgcaccattgcacgccagcctgggcaacaagagggaaactctgtctcgaaaagaaaaaaattattttttaattttaatttgttagtgaacaattagggttgctgtgagaattgtgcctggcacacacagccatttaaaaatcacgatcttcaggcagtgtgtggtggctcacgcctgtaatcccaggactttgggaggccgaggtgggtggatcacctgaggacagggattcgagagcagcctggccaacatggtgaaaccccgtctctactaaaaatataaaaattagccgggtgtggtgatgcgggcctgtgatcccagctactcgggaggctgaagcaggagaattgcttgaactcagaaggcagaggttgcagtgagtggagatcacgccactgcattccagcctgggagacagagggagatttcatctcaaaataaataaataaacaaaatcaagatcatttaacaaatacatatattgtacttactaagttcaaatttctgttctaaacgtttttacaaatgctgttaagtcatttagtcctctgcataatgtcgtttgtttgtttgtctgttctttaagacggagtcttgccctgtcgcctaggctagagtgcagtggtgtgatctcggctcactgcaaccgccacctcccggtttcccgtgattctcctgcctcagcctcctgagtagctgggattacaggtgcgtgccaccacatccggctaattttttgtatctttagtagagacggggtttcaccatgtgccaggctggtcttgaactcctgacctcgtgatccacccgccttggcctcccaaagtgctgggattacaggcgtgaccaccgcgccagacccataatggcgttttatagatggggaaacggagtcatagaggctaaacaactttcccaagaccacacagttagtaaggggcaggactaggactcaaagccaagtttatgaccaaattctggtgcactacgttctcctgcttctggagaagataatgatgctgaagattctacttttggtgtaaaggagtaggaagggcacggggcactgctagcttcagtgggcctgaatctttgtctttccttctgatttggagaaagtgcaagaatgggaaaatgcaatcgaagtgaaggagaggccggcgtattttcctgaaatgcgcggcccgcaagcccaaacccgtttcccgggtgtccaggcagcgttctgcagcatctccaatgcccgccagcccgccgcagcccagcgcccggcagccggcgcctctcaaaccccctccggccaggagccttcgccgcttggccgcgccgcgcccggcctgggaaaaaagtttccaaacgacgctgctctgcgctgattggccgaggcggacgcggtaccgtagagcagcagccaatgggaggcgccgaccgcaggctccggggcgggggcggggtccggagggccggggccgcaccgcccttcgcagccgcctctgccgccgccgccgcgttggcctcgccgcccctgctcgggtaagtgaggcgctgcgcggggctggggtcggggtggctgtccggggacctccaccgcggctgaaaagctcctctgccccgccccaggatcccgggaccccgggccaccgcctggcagggacccctacgcccctcgcttgcgcgtcgcttcccggccgcctggactcccccggtccctgggctccaaaatcccgcctccctggagcctcccgtcctaaaaagttaggcactgagtgccttgccaccggtgcgttcctcgcgctggcccctcgcccttggcaactttgtttctctttctgcgttggtctctctcccaccccgttgccctcttctccttccgggacttcctgggtggttaagccttgccggtccccaaaccccgctgccaggctccatcctctttctcctcttccttcctccccatactcctctcctagatgaccctcgtttcttttctctctctctcctattcctccatcctgccacccgcttctctgcgaccccagacccctcgattgcagcgttgcccctgccctcacacccactgtcccgcccctgcaggcctctttccaaaaacccaccctgctccctccctccgggaacacgtttggggcagtctgctctccgctttgctcccgtctctgccgcaggacggttcaggtttcttctgacagcactttggggagggattgggtaaaggacgaaaatgcttattccgcagcttgagtgatggctgggctcactgaggacctgagtctctgaggtcctgggaaaccccgctgtcaccttgacaccgcttttggggaggcgactttatcttctccgagccatctcaggctttctgcctcctgagggcctgagcttccttgattgctttgtccgtggttactaccaggttgtgcctcttaatttctactttgagcctcaggccccttttaactttctaaagaaaaggcctttgcagcacgacctaggcaggttcatcatttttagttttgttatagtgtattctagcataggatggcattttaggacatgggtcgggtgttttgaagattaattagatcccagctactcctaaagcctcttgttacccgaccaccccagcctccatcacctcgttggtatacaacccgtttttttttttttttttttgtttttgtttttgagacagagtctcactctcgcccaggttggagtgcagtggtgcgattttggctcactgcaacctccgcttcccgggttcaagcgattctcctgcctcagcctccggagtagctgggactacaggtgcgtgccaccacgcctggctaattttttgtatttttagtagagatggggtttcaccgtgttagccaggatggtctcgatttcctgacctcgtgatctgccccctcggcctcccaaagtgctgggattacaggcgtgagccaccgtgccggcctacaacccattttgagcctttcctcttagtgtgtgttttgtgtaggattaaatgcagatgatctgtgccgctgaagtctcaggggcctgtgattcatatattttatcccatgttggataacagtttattaacttgacttatttttgtttccaaagtgtgttatttattatttatttatttatttattttgagacggagtcttgttcttgtccaggctggagtgcagtggcatgatctcgactcactgcaacctcagtcctccgggttcaagtgattcttctgcctcaccctcctgagtagctgggattacaggtgcgtgccaccatgcccggctaattcttagtagagatggggtttcaccatattggccaggctggtctcaaacttctgacctcgtgatctgcccacctcagcctcccaaagtgttgggattacaggcatgagccactgcacccgactctatcattattattattttttatgtagaggcagaatcttgctttgttgcccaggctggtctcaaattcctgggctcaagcagtcctcctgccttggcctcccacagtgctgagattacttgcaggcatgagccactgcatgcagcccaaagtgtgttcttttgccttagaatgtgagccgagaattgacactccttttcctcacaaggtaatttcctaacatgagcattcctgtgtacagaaagtttgtgcctgcagttagtactacacgtgcacctcgtgcaatggatgtgggtgctttttgtctgcctccttcagcagtgcccagcacttagtaggtattcaagaaatgtttgaaaagggttggaggaggcaaaaccacagtaggaaaaattctttccctgtcacttggttcagtagaataaaattatcctggaacaatagctattttactttttgtccaagtttttgtttgtttgttttttgagacgggatctcactctgtcgcccaagctggaacacagtgatgcaatcacagctcactgcagtctcgacctctcaggctcaagcaatcctcttgcctgagcctcccaagtagctgggactaaaagcacatgccaccatgcttggctaatttttaaaattttttgtagagattggggtctcactatgttgcccaggctggtctcgaactcctgggttcaagcgatccttccgcctcagcctcccaacgtgccggggtgggagagagccaccgcgcctggcctaagctttttaaaatctctaaagcgatctatgcttactgtatatatgtgtatgtagtttaccttaaagcaaggtgtcaggtacaaatccacagggcttgctttacccccattctggtgcatcctccagacccttttctattctgtgtacagagagagggaaataaacaaaaatgggcacccatttttaacatatcctgagctttcttccatattagtacttacagttcttaacaactgcatcgttttccattcagtcctctgttgacattgaggtttccagttttccacattcgtgaatgatggtgtgcatctttgaacatgggtccttgcctgcctaagtatttttgtaggttgatcattgtaaacttggaaagcacaaagacagaagccaggcttgctgactcttgactgatgttgccccagtgatgtcactcctgcaaaatgcaaagcctgcgtcctggctgtcggagcatgtgtggacatttggcagcttctttctcttccctcctgctcttctgtttgttttgattgggaaggatatggagtggggatggagaagggtgttgagtaattatcgatggtttctgtatgtttattgctcctgactagcagtgctgggtttcttctctcagaggaaagctgaaagagattgctttgcttttttccagagttttaaaatcagaggtgtgtgtctcgagtgtattttcagacttttttgttagctttaatcatgtaaaacatgcaaaaaaaaaaaaagcatgtggaaacaattttttttttttgagacgggttctcgctctgtcacacaggctggagtgctgtggggcgatctcggctcactgcaaccaccgcctcccatgctcaagtgatcctcccacctcagcctcctgagtagctgggaccacaggtgtgcatcaccacacctggctaatttttttgtgtttttggtagagatggggtttcaccatgttgcccaggctggtctcttatctgctgacctcaggtgatctgcctgcctcaccctcccaaagtgctgggattacaggcatgagccaccacacccggccggaaacaaatttttgaaggaggcatagatctctgttgtgcaaaatagatactttttgtaccactgggtcctagtttgtcattgttccttgcatgatcccatcagatttgtctacagagctgctggggcatgatggtgtggtggcgtattaagaacgcaggttagtggcacacagatgaaataaatgcatgtggggtgcatttttaagatagcaggtgcaaagttgtatatactgagaccaggcattaacacttgcctattacagtgccttttaaaacactatgtgagggccgggtgcaatggctcacacctgtaatcccagcactttgggaggcctaggtgggcagatcacctgaggtcaggagatcgagaccagcctggccaacgtggcgaaaccccgtctctcctaaaaatacaaaaaattagccagtcgtggtggcatgcacctgtaatccgaggtactagggacgctgaggtaggagaatcgcttgaagctgcgaggcagaggttgcagtgagctgagatcacaccactgcactccagcctgggcaacagagaaagagattccgactcaaaaaaaaaaaaaacaaaaaaaaaaaaaacaaaactggaccaaatgaaacaagtgaatctgatctgcagtcagtcagtttgcaacccctgggaagccttggacttgaatgcaaagatcccttgaacttggatctagtttgcctctgctgctcacatgcacatttagagatggccaaggcatacggtgtttctgcttccaagaaacagagtggttgtcctgtttagccatctcttacagtcacacagcttaaagaagataatgtttgcaaacaatttttgaaatgtctagcacacagcaaacagaaggtcaaattcagtacttaatgctgataaaataagagaacccttgcaagtcatgttgcctgctttctgccacagagagtactgcaatagaactttctgacgttttcatgttgtttatttatttattttttgagacagagtcttgctcttgtgcccaggctggagtgcagtggtacaatttctgctcactgcaacctctgcctctgggttcaagcaattcttgggcctcagccacccaagtagctggaattataggtgcgctctaccacacctggctaatttttgtgtttctagtagagacagggtttcaccatgttgcccaggctggtcttgaacccctgggctcaagcaatccacccacctcagcctcccaaagtgctgggactacaggcgtgcatcgtgacgccctgctgatttgtgtatttttagtagagacggggttcaccttgtgctggtctcaaactcctgggctcaagcaatctgcccacctcagtctgccaaagtgctgggattacaggcgtgagccatcgtgcccggcctctctctgacatttttgaatggcaaaggcaaaaatcttatacttttaaggatgtggagaaataggaacacttttacactgttggtgggactgtaaactagttcaaccattgtagaagtcagtgtggtgattcctcagggatctagaactggaaataccatttgacccagccatcgcattactgggtatatacccaaaggactataaatcatgcttctataaagacacatgcacacgtatgtttattgcggcattattcacaatagcaaagacttggaaccaacccaaatgtccagcaatgatagactggattaagaaaacgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaacgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaagaaaaagaaaaaaaaagattgctgttttatgataaagtgaagtgcagctgttacttcttccttctttgcttccagcatctctcttccctaaggattgcttttaaaatgtaagagtttttggttgaaatgctgttcctgtggtttttgtctcttggttggagtgaaagattttgcaggctgtgatacaaatccagttctctgcttattttctcctcagtccttgaaatccaaaaccagatccctcccattggcccgttgtaattagaacctgccccacaatagacgcacctcctaaagcatctcagattcatttctttcctgaggattaagtttttaaaccttcctggccaagataacagtgttttaagaggctcttttcttttattattattattattattattactcttttctttttttgagatggagtcttgctctgtcacccaggctggagtgcagtggcaggatctctgctcactggaacctccacctcccgggttcaagagtttcttctgtttcagcctcctgagtagatgggattacaggcatgtgccaccatgcccagctaatttttgtatttttagcagagatggggttttaccatgttggccaggctggtctcgaactcctggcttcaagtgatctacccgctgtggcctcccaaagtatcaggattacaggcatgagccacagcaccctgccaggcttgggtgttcaaggaagagaaagaaggcagtgtggctgggacataagtgaatgagaggtggtagggtaagaaatgtgtagaaaactatgcaggggcctgatcacattggatcttgcacatctttttccaaacctcaggaggagtcattctgcttttgttgttactggttcctcacttccgcactttattgtatgctgacaaccttccataccatgggactgagactgccctcaatagtatcaccaatgtctttttttgttttttttttttgaggcagagtttcactcttgtcgtccaggttggagtgcaatggcgtgatcttggctcactgcaacctccgcctcctgggttcaagcgattttcctgcctcagtcttccgagtagctggggttacaggagcctgccaccacacctggctaatttcttgtatttttagtggaaatggagtttcaccatgttggccaggctggtcttgaactcctgacctcaggtgaaccacccgccttggcttcccaaagtgttgggattacaggcatgagccaacgcacccagccaccaatatcttaatggccacacagtgctcattgatagatgccttggccctgggctattgttgctatagaattggtttgatgagtacatattacatgagatctgggctcattagagcttatggcttgagcagggactccttggcctaggtttatgctgctcctggccttgttaatgactgctattaacactctaccccctttttatttttttgagatggggtcttgttctgtcgcccaggctgggaggctggaatgcagtgatcttggctcactgcagcctccgcttctcaggcttaagtgatttttcctgcttcatccttctgagtagctgggactacaggcacgcaccgccgtgcccgtttgatttttgtttttgtttttttagtagacacggggtttcaccatgttgcccaggctggtctcaaactcctgacctcaagtgatctgtctgcctcggcctcacaaagggctgggattacaggcatgagccattgcgccaggcaccactctacccttttgactttgagcaagtaaggtcgttgattccatacattcattaagattcctgcgtggcagaaatctaaccccaactggtataaccaagacaaggaattgattatctcataaccttaaatcaggtgtggctgcatctaggtgttcaaatgatattgtcaggacccaggctctccatcccttggcccagctttcctctgttttggcttcactctgaggcaggctctcccttgtgatagcaagatgaccaccggcagtttcaggcttacctccggcttcaggcttacctccagcttcaggcttaccttaccaaccctagtggaaagagagtttcatttttgacagctatgcaaaaggtctggacctgggccctcactggcttagtatgggttaggcccatccttaagccaatcattggctcagcatgggttagatccgtgactgtcactggctgagcatgggggttaggctcaccctatcattggctctgcgtgaattaggcccacctctgtcactggctcatcgtgggttaggcccacccatgagctgatcactaaggtcgtgaataggcatatgcctcttcccaggtgtggaggatgatgtcagatccctctgaactcatgaaatgagtagggtattctcccaagggaatattgtgctgtcacagaagatggaaaaatgaatgcatgtctggaaaaaacaagcaaaactacaaatcattagctttatatgacatttatttattttttgtttatatgtttttgaaatggagtcttgctctgttgcccaggctggagtgcagtggtgtgatcgtggttcactgcaacctctggctcccgggttcaagcgattctcatgccttagcctcccgagtagttgggatcataggtgcctgccaccacacccagctaatttttgtgcttttagtgtagacaggattttaccatgttggccaagcttgtcttgaactcttgacctcaagtcatctgcctgcctcagcttcccaaagtgttgagattacaggcatgagccaccacgtctggccagctttgtatgacatttcgcctttctgccttgatcaaactttcagagaatctgctttccagagggatgagtgggtcgggaaatagcatgttttctctgaatgagggaaaggattgaaaaagtaggagggagaaaggatgtgaatatgagtcccaacaaatgcagagttatcggtaagttttgtgcttgaatctaggtacaattgtgcatttcctggttctgcatgaattaggcccacctctgtcattggctcaacatgggtgaggctcactaacttccaccagaagttagtggtggtgtctgtgttgacacttacatgtttagcctaatgatttcatgttttaaccaaaactatatagcttgttggttatatcttagaaagtgatggtttttgctcattcttttgtccccagggatacacaccagcctctaagttctcttgagggaaggaagggaccttgcacacaatctttttttttttttttttttttttttttttgagaggaagtctcactctgtcacccaggctggagtgcagtggtgcgatctcggctcactacaacctctgccttctgggttcaagtgattctcccgcctcagcctcccgagtagtggggattacaggcgcacaccaccatgcccggctaatttttatatttttagtagagatggggtttcagtgtgttggccaggctggtttcagactcctgagctcaggtgattcacctgccctggcctcccaaagtactgggattacaggtgtgagccactgcgcccggccttggacacaatcttttttttttttttttttgagacggagtctcgctctgtcactcaggctggagtgcagtggcacgatctcagctcattgcaacctccacctcctgggttcaagcaattctcctgccttagccgcctgagtagctgggactacaggtacctgccactgcgcccgcctaatttttgtatttttagtagagatggggtttcaccatattggccaggctggtctcaaactcctgaccttgtgatctgcccgcctcggcctcccaaagtgctgggattacagatgcgagccactgagtctggcctggacacaatcttacttggattcctcatgcccttttgacaagctcagagcctcaaataaattcagaaaataggtgattacatcaaacagcctctatcaacagggagtatacaaaccgttagcccaactgttaatagaagtctgctttcttgctgggtgtggtggctcacacctagaatcctagtgctttgggagtacaaggcaggaggatcgcttgagcccaggaatttgagaccagcctaggcaacatagtaagaccccatctcttaaaaaaaaaattagcttggcgtagtggcctatacctgtagtcccagctagtcaggaggctgaggcaggaggatcagtgccgcctaggagttcaaagatgcagtgagctatgattgtgtcactgcactccagctgggttgacagattgagaccctatctcttaaaaaaaaaattgcttccctcacctctgctgtgaaacagctcaaagtcctgagagccaaggcccctaccgcccacatcctctagctgttggctaatttatttcatcgtcttttaggtaattctccagaattccatcgctttcctctttttcacctcccagttactcctgcactcagttcttcgtctttcctcctccactgtgtagaaactgttcttgctcacaccgccagtgaccgactttcgctcagccttgtggatattttccagcccttatcttccctgcttctctgttgcatccttgtgacactggaatgtttcccttttttcccttgaaaccgcccactcccaggacagcacagtcttcctgattctcatctctctcactctgtttcttctctgcctccttcggttaccatttcttaaactgcccacctttccaatattggcattcttcactgttccatacacagtccctaggcgattcttccatggtcacgaggaaaagagaaaaaccagctatagacgcatgactttcaaatggatattgttgacccaatttcaaccctgagtttcagctgcgatattgcatcttggtgtgtcatggacatgtcaagctgtgaatgtctgagactgggtttgttatctctccttaacccacccacctacccaagagttttacttgttttttttttttttttgagtctcgctctgtcacccaggctggagtgcagtggcgccatctcggctcactgcaagctccgcctcccgggttcaagccattctcctgcctcagcctcctgactagctgggactacaggcacccgctgccaggcctggataattttttgtatttttaatagagacagtgtttcaccatgttagccagaatggtcttgatctcctaacctcgtgatccacctgcctcggcctcccaaagtgctgggattacaggtgtgagccaccgcgcccggccgagttttccttttgattgtcctttttttttgagacgggatcttgctgtgttgcccaggctggagtacagtggcatggtcatgggtcactgcagcctcgacctctccttgcccctcatcctctcgagtagctggaactacagacacaccaccatgaccagctagtttttgtattttttgtagagatagggtctcaccaggttgcccaggctggtctggaactcctgggctcaagcattccacctgctttggcctaccaatgtgctgggattacaggtgcgaggcactgcacccagccaccttctggaagtctttatctctggtgatggggatggtggcggcacccaattgcctaaggtagagccccagaagatgtcctcacctcctttttctctctcccctgccccgaaaagtcataattcatcaagttctggtaagtttgccttctaaatatttttggagtccatttctgttccctccatcttcattcctactttctttttttttagacaaggtctcactctcttgcccaggctggagtgcagtaccgtgatcatagcttactgcagcctcaaattcctggactcatgtgatcctccttcctcagcctccagagtagctaggactacagatgtgttgcaccacaccagtctaattttttaaaaagtttttttgtcaaggtagggtcttgctgtgtttcccaggctggtcttgaactcctggtcccaagtggtcctcttgccttggcctcccatagtgctgggattatacgtgtgagccactgtacctggcctattctcactttctaattcaggccacgttcctttctcttttcttttttttttttttttttttgagatggagtcttgatctgtcgcccaggcttgagtgcagtggcgtgatctcggctcactgcaagctctgcttcccaggttcacgctattctcctgcctcagcctcccgagtagctgggactacaggcacctgccaccacgcccagctaatttttttgtatttttagtagggacagggtttcaccgtgttagacaggatggtctcaatctcctgacctcatgatccgcctgcctcggcctcccaaagtgctgggattacaggcatgagccaccgtgcctggtctcttttcttttttaaataggatctcacttcatcacccaggctttagtgcagtggcactatcttggctcaccgcaacctctgcctcctgtgctcaggtgatcctcccatctcagcctcctgagtagctgggaacacaggcatgtgccaccacagctggctgatatttttctatttttagtagagacggagtttctccatgttacccaggctggtctcaaactcccaggctcaagcgatctgcctaccttggcctgtcaaagtgctgggattataggcgtgagccactgcacctggcctccaccttcctttctttcttgcattgctgcaggagctccccatcttaggccttgtccttcctctgcctgtccatggccaccaggaccagctttttaagcaggagagcccatcatatcacatcactctcttccctaactttctccaatggtttcccattgccactaagtttcttaacatcttgcaaaagccgtctgtgacttagcccctttatttcagtctgtccaggtaggttcccttccactcgtcacctttcaacccaggcttaccagactccctctagctcccctacaagtgcctggctgtttctcctcattccttcttcccctgctcaattaccattgccttccagttctttcatattcttttttttttttttttgagacggagtctcattctgtcgcccagtctggagtgcagcggcacgatctcagctcactgcaacttccacctcccaggttcaagtgattctaccgcctcagtctcctgagtagctgggagtatgggtgcccgccaccacgcccagctaatttttgtatttttttttagtagagacggagtttcaccatattggccaggctggtctcgaactcctgccctcgtgatctgcctgcctcagcctcccagtgtgctgggattacaggcgtgagccactgcacctggctttttcatattctttcacatgctcctcatgtgtcgcctcttctaggaagccttccttgactttcgggttgagttttgaacttcttaaatatcctgggcactgatagaaatgtattttcaggtgcatacatatttcagaacacaccaatgtgtatactcaaatatatgcaatttattgcatgtcaaaatcctgtgcacatttctgtggctatactaggcacatagttttatcataatttacatggggttgggtgcggtggttcacgcctgtaataccagcactttgggaggctgaggtgggtggttcacttgaggtcaggagtttgagaccagcctggccaacatggtgaaaccctgtctctactaaaaatagaaaaattagccaggcgtggtggcgcatgcctgtaaaatcgcagttgctcgggaggctgaggcacaagaatcatttgaacccaggaggcagaggttgcagtgagctgagatcacgccactgcactccagcctgggtgatagagcaagagtctgtctcaaataataattataattattattttatgcgtaatttccattccagcccccactcccccactccctccaccagactgtgaggcccctttagggaaggcaggcatcttggagacgttttatgtggctccctaggtcctttagtaggtgctcaataaatatttgcatagggatatccatgagccttgatgttaacccagggaatataacaggtgagtggattgtgttttgtttgggtttagcttcagatttttggcagtatttaatcatttaacccagcataaagtttatttatttatttatttattttgacacagagtctcggtctgtcactcaagctggagtgcagtggcgccatctcggctcactgcaagctccacctcctgagttcacaccattctcctgcctcagcctcctgagtagctgggactacaggcacccgccaccacacccagctaatttttcgtattttagtagagacggggtttcaccatgttagctagggtggtctcgatctcctgacctcgtgatccgcccgcctcagcctcccaaagtgctgggattataggcgtgagccaccgcgcctggccaagtttttttttttttttctgttaaaggggatcagctgtttaaccagatgtgggtaatcattttgaaaccttctctcctagacaccatgccacaaggagagtgatctcttcccctgttttcacaatggaggactccggaaagactttcagctccgaggaggaagaagctaactattggaaagatctggcgatgacctacaaacagaggtcagtccgagttcacctgcttttccttttttttttttttttgagatggggtcctgctatgttacctaggctgagtgcggtggctgttcctaggcgtgatcatagtgcacagccgccttaaactcctgggcttaagcgatcatcctggctcagcctcccaagtagatgggactataggtgtgcttcatcaggccaggcttttttttttttggcggaaacaggggtctcgctatgttgcccaggctggtcttgaactcctggactcaagtgatgcacctctgcctcccacagtgttgggactacaggtgtgagctctcttttttctataaaaagaacagcaaccatttattgcaggcctatatgtgccaggcagtgtgaaaggcttaacttacactatctcaaaactgcctgtgaaaaaactattagcaccccattatatagatgaagaaactgagcctcagtgaaggcagataacttgctcacagtcacacagccaataagtagcagagctggaatttgaactccagacctatggtcctgattatcctactatgctactttacattttgttttcttattttctttttcttcttttttttttgagacagagtctcactctgttgcccaggctggagtgcagtggtgccatcttggctcactgcagcctccacctctgggttgaagcaattctcgtgcctcagcttctcgagtagctggaattacaggcacccaccaccacgcctggctaattttttgtgtttttagcagagacggggttttgccatgctggtcaggctggtcttgaactcctggcttcacgtgatctgcccgtctcaccctcccaaagttctggaattacaggcatgagccaccatgcctggccttccatcttattttcttttttttttttttgagatggagtttcgctcttcttgcccaggctgtagtgcaatggcatgatctcggctcaccacaagctccacctcctgggttcaatcgattctcttgcctcagcctcccgagtagctaggattacaggcatgcaccaccatgcccagctaattttgtatttttagtagagacggggtttctccatgttggtcaggcagctctcgaactcccaacctcaggtgatccacttgcctcggcttccctaagtgctgggattacaggcgtgagccaccacgcccggtgtccatcttattttctagaagggtttttatcagttcctagatgccatatctggtaagttctttgtgcacagggaaagagcttttccctatgcctagcaaaatatattgctaaagattttaagatttgaaactcgtgttttggtcagggctcatatctgggaggtgtgtgtgtgtgcgtttggtttggcactgtttttatttataatgggtctttataatttgtacatagaggccttattccagtccccttagtttctttcatttattgaaaaattattttaggtccaggcacagtggctcacatctgtaatcccagcactttgggtaggcagatcacttgagctcaggagtttgagaccagctctagcaacatggcaaaaccctgtctgtacaaaaaatacagaaattagcaggcatggtggcatgttcttatagtctcagctacttgggagcctgaggtgggagaattgcttgagcctgggaggtcgaggctgcagtgacgcatgatcacacctctgcattccagtctgggtgacagagcaagactctatctcaaataaataaataaaaattattttagagtcagggtctcactctgtcacccaggctgaattgcactggctcttcacaagtgtgacctatctcactgcaacccctgggaccccaggtgatccttctgcctcagcctcccaggtagctgggactacaggcgtgtgccaccatgtctggctgatttttaaacacatttctgtagagatgaggtcttactatgttgccctggctggtctggaactcctggcctcaagtaattcttaatgagccactgtacccagcccttcctactttctttattctagtttgacttaaaggtaattcaggcttgatatttttaaaatattccttgaatttggccaggtacaatggctaacgcctgtaatcccagcactttgagaggccgaggcaggcagatcacctccagtcaggagatcgagaccagcctggccaacatggtgaaaccccgtcactactaaaaatacaaaaattagctgggtgtggtgccgcatgcctgtagtcccagctactcgggagactgaggcaggagaatcgcttgaacctggaaagcagaggttgcagtgagacgagattgcagcactgcattgcagcctgggtgatagagcgagactctgtcttcaaaaatattactacgtgatgattaacaattttgctgtagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggtgaggggctgagaggaagtgtgctcaggtgtagacaggcgtccaacacaggcatggcatgcttggctggaagaaggaaccctgcaatgagggactccagaccccaggcccatgctcatctctggaagggcctgtgcggcagacgtgatctttgaactctttgtgcctctagtgggtggtgctttttgttttgttttttttttttttttgagatggagtttcactcttgttgcccaggctggagggcagtggcgcgatcttggctcactgcaacctccacctcccaggttcaagtaattctcctgcctcagcctcctgagtagctgggattataggcgcctgctaccacgcctggctaattttttttgtatttgtagtagagacggggttttatgttggccaggctggtctcgaactcctgacctcgggatccatgatgggtggagctttgagaagcaagtcacacacatgttcccgtggactttcttggttgtgtacactgattttatagggcacatggcagggagacttttttttttttttgaaacagggtcttgctctgttgcccagactggagtacagtggctggattacagctcactgcaccctggacgtctcaggtttaagcagtcctctcacctgggccgggcgaggtggtgcatacctgtaatcccagcactttgggaggctgaggtgggcagatcacgaggtcaagagattgagaccatcctggccaacatgatgaaaccctgtctctactaaaattacaaatattagctgggcgtggtggtacacgcctatagtcccagcttacttgggaggctgaggcaggagaatcacttgatggttggaggctgtagtgagctgagattgtgccactgcactccagcctggcaacagagcgagactccgtctcaaaaaaaaccaaagtccttccacctgaacctcgggagtagctgagactacaggcatgcggcaccatgcctggttagtttttgtattttttatagagacagggtttcgctgtgttgcccaggctggtcttgaactcctggacgcgagcagtcctcctgccttggcctcccaaattgctgggattataggcatgagccaccacctggccagggagacatttttagggtatggaggtgttgctagagtaatatcatcaggtccaatattgtagcccttagctacatttggctgttgaaatttaatgaattaaaataaaaacttaattcctcagtcacagtagccacatttcaagtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactgaggtttgctttgtgggttttttgtttgtttgttttgtatttttgagatggagtcttgctctgttgcccaggctggagtgcagtagcgcgatctcggctcactgcaagctccgcctcccaggttcacaccattctcctgcctcagcctcccgagtagctaggactacaggcgcctgccaccacgcctggctaaattttttgtatttttagtagaaacggggtttcaccgtgttagctaggatggtcttgatctcctgacctcaggatccgcctgcctcagcctcccaaagtgctgggaatacaggcgtgagccactgtgcccagcctgttttttttttgagatggagtcttgctctgttgcccaggctggagtgcagtggcacaatctcacctcactgcaacctccgcctcccaggttcaagtgattgtcccgcctcagcctcttgagtagctgggattacaggcaccctccaccacgcctggctaattttttttttttttttttttgagacgcagtctcactctgttgccaggctggagtgcagtggcgtaatcccggctcactgcaacctccacctcctgggttcaagtgattctcctgcctcagcctcctgagtagctgagattacaggcacacaccgccatgcctggctaatttttgtatttttagtagagatggggtttcaccatgttttccaggatggtcttgatctcttgacagtgtgatctacccgccttagcctcccaaagtgctgggattacaggtgtgagccaccacgcccggctaatttttgtatttttagcaaggacgaggtttcaccatgttggccaggctggtctcgaactcctgagctcaggtgatccgcccgcctcagcctcccaaagtgctgggattacaagcatgagtcaccccgcctgaccacactgtgggatgtttggcagcatccctggcctccaccctctagatgccagtagcattccccgcacctccaaggtggtgaaaaccaaaagcacctctagacatagccaggtatctggagacccagtgctctgcaaggtaaaaaccatcccttctgtacatgctgtagggctcagcaagggatcactaagtcaacaccgtgccccagagactggctctcagccttagctgccagccagcatcactaggccagcttcataaacatccgacaggcctgaaccctctctccccatccccatctccccgccttgctctgagattccatttctcagtaagtctgggtggggccctggcatgtctgtgtggttttctttttctcattaaactcccaatgtacattttgatgagctgcttcatggaagagtcaaaactgtgtgtgcccagggctaggtatgatggacggtgaaaggggaagtgctggttgccttctttgggaagacaaacctaatgccatgaagcagttggggacgtgaagctcagtcacagaactctgatgtgggggcctttcaagagaaaaaggactggctgggtgcggtggctcatgcctgttatcccagcacttcaggaggccgaggtgggcagatcacctgaggttgggagtttgagaccagcctcaccaacatgacaaaaccctgtctctactaaaactacaaaattagctgggtgttgttgtatgtgcctgtaatcccagctacttgggaggctgaggcaggagaatcacttgaacccgggaggcggaggttgcagtgagccgagattgcaccattgcactctagcttgggcaacaagagcgaaactctgtctcaaaaaaaaaaaaaaagaaagaaaaagaaaggactgcatgggttgagggaggctgtgtggagggtgtttgtaggtgtatgtgttgctgacacttggtgcttggggagatggggctgaaggagagttgatctgtacccatcacagacgtggacaagaatgggtgtcgggtggaccttggcaagcccagctttactaatgtataggaaagggtgtgggaccaacaaatggattgggggtttggggcagggcggaggagaggtcccagacacgttgaaggtggtcattgaagctgaagctttctgttggagaccacagagtgcagctggccgtctgcagatccatctgccccataggtgttgtttgatcgccttcaggggtttttgttcagcatttccccatgaacgttttccagcatataaggctgaaagaatttccagtgaatacctgtgtatccaccaccacctaggctctaccaataatatttcccctacttacttgccttttattatatatattcccccatccatcaaaatttgtaaagcttcctgtaaaaagatggatttctggccaggcatggtggttcatacttgtaatcccagccctttgagaggctgaggagggagaattgcttgagaccaggagttcaaggccagcctgggcaacatagcgagactctgtctctacaaaaaaataaaaataaaaaattcattggacatggtagtgcacacctgtagtctaagctactcaagaggctgaggcaggagcattgcttgagcccaggaggttgaggctgcagtgagctatgattgtaccattgcactccatcctgggtgacagagcaaaagttaaaaaataaaaaacctgagtagtggttgtttagaacacacattgttgagtttcccccaatccccatatccgtgacacggagaccttagtgtcatctgcctctccctgtacttggcccacttcacccatttgttaacagctgaacacctgctacacacaatgagcaatgattatcgttctttttgttgttgttgtttttgctgttggagacagagtctccccctgtcacccaggctggagtgcagtggtgtgatctcagctcactgcaacctctgacttccaggcttaagtgatcctcccacctcagcctcccaagtagctgagattacaggcacctgccacaccacgcctggctaatttttgttattttttgtagagacgggttcatgtgcccatgctagtctgggactcctgagctcaagtgatccgcctgcctcggcctctcaaagtgctgggattacaggtgtgagccactgcgcctggctgattatagttcctaaattgaaggggactctgggttgaaaagctgggtaggaggaagattagtggtatgaactgcagtttggagaggataacaggccctccatggatcctgagtaaaatatcaagagaattactcagtaattctctgcttcaagactgagctcttgggcctggcgtggtggctgatgcctgtaatgccagcactttgggagaccgaggcgggcggatcatgaggtcaagagattgagactgtcctcgctaacatggtgaaaccccgtctctactaaaaataaaaaaattagctgggcatggtggcgcacacctgtagtcccagctactcgggggctgaggcaggagaattgcttgaacctaggaggtggaggttgcagtgagctgagattgcgccactgtactgcagccacatgtcagatgcaggagactcagagcacacagcacagtgaagaaacagggtaccttggaataacgaggaccctgccaccagcaagtatttgtcagtcacctaagagaaatatattcagctgggccggacttcttaacaactggcttattcatcacgggttgaatgaaaaagcctttaagggaccaaacagagcatctattgatgcccccatcagctgacagcttattcgaattagccccaaatggcagcacaacatttcagcaacaggttttcatgtccacaggttccgaggagatctctcaatcgccagtgcagtcggtggagcccactcgctgcgtcctcctggagcctgcgtttgaatttaggttaatgacttaagatcctgttttatttggagatgttcccaaataaagggtgtgaggcgatgagagccacgcctgggaacagggcctggtctgcctctacttgctgggtgcagatacttctctgcttacagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagctgggaccataggcacttgccaccacacccagctattttttgtatttttggtagagacgggggtttcaccgtgttggccaggctgttctcaaactcctgacctcaagtgatctgcccgccttggcctcccaagtagctggaactacagccgtgcaccactatgccgggctaatttttgtattttggtttcgccatgttgccccaggctggtgattttttttttttttttaagcgttggcctgggctagagtgcagtggcatgatcatagtttactggagcctcaacctcctggcctcaagcagtcctcccacctcagcctcccccatagctaggactgcaggtgcatgccaccacgcctggctgttcttaaattttctgtagagatggagtcttcctatgttgcctaggctaatatgcctctgccacctgaggtgctgggattgcggcatgaggcaccgcacctggctctgggtgtttggtgaaggaaagtaatttggaagcagagcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcgctggactgtttctttggtaattaacaagatctccctctctgtctctctcctctccttttctctccctttcccttcctccatcttctccctcccttctgtcttagtttttgtttgtttgttttgagatggagtcttgttcgtcgcccagactagagaacagtggcacaatctctgctcactgcaacctccgcctcctgggttcaagcgattctcctgcctcagcctcccgagtggctgggattatagacaacgcaccaccacactcggctaatttttttttgcatttttggtagagacggggtttcaccatgttgtccaggctggtcttgaactcctgacctcaggtgatccacctgcctcagcctcccaaattgctgggattacaggtgtgggtcactgctcccggcctgtctttgtttttaaacccagagattggaatgttctttctgtctccatgctacaacggagagtcctggatcaaaaattcagaataattgactgttgtgtaaaccaagtacatgctgctctcccattgttgtgggcacaaacaacagaagtcattgagattcctttttttttgctttttgagatagctgggtctcactctgttgcccaggttggagtgcagtgatgcaatcacggctcactgcagcttcaacctcccaggctcaaatggtgttcccatctcagcctcctaactgggactacaggcgacgccaccatgccctgctaatttttattttttgtagagactgagtctggctctgtgggccacgctggtgactctttgtaatacggtgataatgtgtgaaagcaggcttgcgttgcccctgtggatgaggcttggagaggtccatgtggctttctttggttgtggacaccttgggcagaatgatttgtctgaagattgctgggggcttcagacaatgatttgtctgaagattgtgggaaccaggtttgggagtgggcaggattcaaggtgctcaaggggcaggaggtgggaggcacttaggacataattgaaacagttattcagtgtgcctgcctgcccgccccctcccagtcccccaccactgccagagagttttgctcttgttgcccaggctggagtgcaatggcacgatctgggctcactgcaacctccgcctcccgggttcaagagattggcctgcctcagcttcccaagtagctgggattatagacgcccgccaccaggcccagctaattttttgtatttttagtagatacggggtttcgccatgttgccaggctggtgattttgggtttttttttttttttgcttgttttttttaagtgtcgtggtctcactctgtggcctgggcgggagtgcagcggcgtgatcatagctcactgcagcctcaacctcctggtctcaggcagtcttcttgcctcaccctcccaagtagctaggactacaggtgcatgccaccacgcctggctgttttcacattttttgtagaggcagagtcttgcccaggctggtcgagaactcctgggctcaagcaatcctgcctctgccacctgaaagtgctgggattacaggcatgaggcaccacacctggctctgggtgtttggtgaaggaaagtaatttggaagcagagccggaacagaatcaagagagctcgggagtgggcaggtgatctggattgaaatggtttggggctggttagcataattgcttaaggacacctgctcaggaggctggggtttgatcttggctcagtcatttgctaccagttgattctgggctagtcaggtcactgagcttcagtgttcatgtctccaaagtgggattaatgagacaacataggtggtgtacttagcctggaggtggcacagaataagtatgtaatggatgttattgctgcagctggcaacagggaatcattgagaagtcagctggactgttcctttggtaattaacatagatctctctccctttccttccctctccctcccttcctctctcctctgtctcccttcctctctcctctctctccctcccccattttatcccctccttttctccctccttctttttctttctttctttgtttttctggtttttttttttttttttgagacagagtctcgctgttattgcccaggctggagtgcagtggtgcaacctccgcctcccgtgttcaagcgattctcccgcgtcagccttctgagtagctgggattataggcatgcaccaccacgcctggctaatttttttgtatttttagtagagtccagatttcaccatgttttcgaggcaggtctcaaacttctgacctcaggtgatccgcccacctcagccctccaaagtgctgggattacaggtgtgagccactgcgcctggcctgtctttatgtttttaaataacctagagatcaaactgttccttttttctccatgtcacaacggggagtcctggatcaaaaattcagaatggcggactgttttaaaaccaagttcatgctgccctcccattgttgtgggcacaaacaacggacgtcattatgatttctttccttttgaggcagcagggagttgcccaggccggagtgcagtggtgccttcacagcccactgcagcttcgacctctcaggctcgaatggtcctcccacctcagcctcgcgagtagctaggactacaggcaagagccaccatgccctgctagtttttattttttgtagaggccaggtctcactctgtgagccgggctggtgactctctttgtaatacactgatgatatgtgtgaaggaggcccatgttgccgtgtggatgaggcttggagaggtttacgtggcttgctttggctgtggacaccttgggtagaatgatttgtctgaagaatgatggaggctataggaatctcaaccctgttgagagtaggcaagattcaaggtgctcagggggcagaggcactcaggacataattaaaacagttggtccgttgtgcctgctttgaatgacacctgcctgttcccaccacgttacatcacttgcctaagagtcagctctggagagaaggttctgttgactgagcctggcttgtctcccgattgtggtgggagggtgggacagaaagcctggagccccacccagggagtgtggtgggaggagtagtttcataaagagagagggtcaggccaggtgcagtggctcacacctgtaatcccagcactttgggaggccgaggcgtgcagatcacttgaggtgtcaggagttcaagaccagcctggccaacgtggtaaaacccggtctctactaaaaatacaaaaattagccactattgttggtgggtggctgtattcccagccacttgggaggctgaggcaggagcattgcttgaacctgggaggcagaggttgcagtgagccaggatcttgccgctgcactcaagcctgggcaacagagtgagactcggcctcaaaagaaaaaaaaaaaaacacggagtcttgctgtgttgcccaggctggagtggagtgttacagtcatagctcactgcagcctctaactcctgggctcaggcagtcctcccagtttagcctcccgagtagctgtgactccaggtggatgtgtgctactgtgtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctgtgctgagtatagggaactaagcagtgagcagaacaaagccagtgcccttctggattttagtgcccggggggaaatggacaatagtcgaagaagtgcaatttcattacagcagcaaggctggcagcccagggtgctgtgggggtgtgtaataggatgtattaatttggctgttggcctgggagcgtcaggcgagccttaccaggggaaatgctatttaggctaagaccagaggaatgagtagccatgatgccaggaggggtgtgagacaagaacattccagacagaacaccaagcctgtgctaagcccctaaggtgggaaggaagctttttcaaagaacagttttttgtttttttttggagacggagagtctctgtcgccaggttggtgtacagtggcgtgatttcggctcactacaatccctgcctcctggattcaagcaattctcatgcctcaggctcctgagtagctggaattacaggcacgtgccaccacaccattctaatttttgtatctttagtagggatgggctcttgccatgttggccaggctggtctcaaactccttagcctccaaagtgctgtgattacaggtgtgagccactgcgcccagcccagtgattcctaaactgatgttctgtggtttagcagaatgataatgactaacatttacagaagaattactctcagccaagcagtttttttggataagaacacttgtttttaaaaaatttatatatgaattatatacagtgaaatgcgcagatgtggccaggcacggtggctcacgcctgtaatcccagcacttttggaggccgaggtgggcggatcacgaggtcaggagatcgagaccatcctggctaacatggtgaaaacccgtctctactaaaaatacaaaaaattagccgggcgtggtggcgggtgcctgtagtcccagctagtcgggaggctgaggcaggagaatgatgtgaactgggaagggcggagcgtgtagtgagccgagattgcgccactgcactccagcctgggtgacagagctagactctgtctcaaaaacaaaacaaaacaaaaaacaacaaaaaaacaaaaaaagcacagatgttttttcttttatttatttttggaaacagggtcttgctctgttacccaggctggagggcagtggtgccaccatagtgcattgcagcctgaaacttctgggagcaagtgatcctcctgcctcaacctcccaaagttctggaattactggcatgagccactgcacccggcctcctcagagagttttttttctgcctcattctttttctcctgtccgtctcggacgccatctatacacataacctttttatattgtcaggcaggttcctaaggctctcttcatttttcttttccctaattatttttttgtctttgttcttcaaattgaataatttctgtttatccagtttcaagttgatagacgccctcttctctctccaatctgccattatagcagatgaaatattgaattttcaatatattgtatttttagatgtaggatttgtgtttgttcttttataatttctgttctattgaggtttcttgacatccttgagcatagttgtaagagctgctttgaggtccttttgtgcagttttcaacatctgggtcacattttctttatactccacgcattcaataactttggggttgtattgtaggcagtgtgagtggtgtttcccacgtggtgtttcccacagactattagttgttttttgtttttgtttttgttttaagacagtcttgctctgtcgcccaggctggagtgcagtggtgcgatctctgctcactgcaacttccacctcccagattcaagtgattctcctgcctcaacctccggagtagctgggattacaggtgtgtgttaccacacccggctaatttttgtatttttagtagagatgggatttcaccatgttggccaatctggtctcatactcctgacctgaggtgatctgcctgcctcggtctccgaaagtgctgggattacgggcttgagccaccatacccagccagagatgatgaattcttttatgttcttgatttatttggttttcttaggtggtttacttggctgagcttacagcccaaattctgtctcccctttgatgggcagtagctgaaatctctttgctttttttagccgtaactgggctgctttgtgtctgctctgtgcacgtgtggtttgggggaggccagagatgtgggaagatactatattcagaatgtgggggggcccacggtgatagatttctatccctggagctttaggcaaaaatcttgtaaagatgcagacttcacccagtcttgttctgtttttctaagcgttgttttccagttcctgccagtgcactcagattattgttgtaaacattttacttagaatttatacgaggtttgatctgatacaggtttcctggtcattaccagaagtggaaattcctttcttgtcaatctgtaggagttctttgcatatatatattttttgagatggagtctcgctctgtctcccaggctggagctggagttcagtggtgtgatctcaggtcactgcaaccactgccttcctgcttcaagtgattctcctgcctcagcctcccaagtagctgggattacaggcgccccccaccacgcctggctaatttttgtatttttagcagagacggagttttgcgatgttggagaggctggtcttgaactcctgacctcaagtgatccacctgcctcagattcccaaagctggaattacaggcatgaaccactgtgcctggccctttgtatatttttactactaatcttttctcctgcattgaaaataattttttccgtggtaatcttttgtttgttgactttgtctattgtatcattttccatacaaatatttccttttttctcttttgaaaaaaaattttttatacatgtatttttcatttttaggtcatcagttacatctttttttaaataccttctaggtttgcagatttcactagggaagtctccttggttcttgattgttcatgtgttttgtgttttttttgcaatattttttaattgtttaatttttttgtatccttattccttagtctgcaatgaatttatttttgtatctagtataagatacaagttcaattttatttttattttctttaggtggatagcccagttgtgccagcactgttaaacactgccttttttttttttttttttttttttttttttgagactgggcctcgctccattgcccagagtagagtgccatggtgcaattacagctcactggagccttgacctcctggggcaagtgattctcccacctcagcctcctgagtgtctgggactataggcatgtgccactatacctggctaatttttgtattttttgtagatacagggtttttccatgttgcctaggctggtctcaaagtcctggactcggtctgtccaccttggcctcccaaagtgctgggattataggcatgagccaccatacccggcctttggcatattttaaaattgggttgttcgttgttttttttcccatgatttctaggagatttttatatatttgtctgtgacatgaatggacagtattgggagtttgtcatttgtttccagctttgtctgatgtatattttattgtacagagttactgatttgttttgttttgagtcagagtcttgccctatggcccaggctggagtgcaggtgcaggatctcggctaactgcaacctccaccctcccaggttcaagctattctcctgcctcagcctcccaagtagctgggattacaggcgcccactgccacgcctggctaatttttgtatttttagcggagatggggtttcaccatgttggccaggctggtatttgatttttttgtagtcagatttcttagtcatagttagaagggccttgtgcactccaaggtttataaagcaattagccaagtgttttcttgtagtatttttgttttttctttcttttctatttttatttttgtactaaacgtgcattgtttttgttaatacaatttggccaaatgctgaatagtttagtgttaaaaatcggatgaggtagaagcccagttcaccattatagaatcaataaagttctaggtcaccaaagttttatgtatttatgttttgagacaaggtctctctctgtcgcccctgctggagtgcagtggcacgatcacttcagcctccccagtagctgggactacagtcatgtgccaccatgactcactaatttgtgtattctttgtaaagaccgggtttctccatgttgcctaggctccaaagctttattttaaagacttgaaaatgttacaattttgtgcaagtttaatagttatatttagaacgtttgacagtcttctccaagaacaagagtttctcagcaccatcagctgtttgattgctctcatggtccttcttctatacgtccctcaaacgaaactactcacttttaactgaggacaggcactttgtataagaataaccttgaaaagtgtgcaggacctaattggaagtaactaaaaattaaatacatttcctaaaggttactttgtttcatatgagtactaagatgccaaaaagttttacaaaaattcaaatagatttaatctagttttactcttttcataagtttttcattttattttatttatttatttttgagacagagtcttgctctgtagcccaggctggagtgcagtggtgcgatcttagctcactgcagcctctgcctcccaggttcaaatgattttcctgcctcagcctctcgagtagctgggactacattgcatgtgccattatgcccagctaatttttctatttttagtagaaatggggtctcaccatggtcctgacctcaagcgatccaccacctcggcctcccaaagtgctgggattatagccgttagctctcacacccagtccaacttacacattttttttttttaaagagatggggtcacacagtgtttcccaggctggtctcaaactcctggattcaaacaatcttcccatctcggcttgccaaagtgttgggattacaagcatgagccactgtgcccagccaattccatggacttttaaagcattttttggctcaaaaaggatatgttcttagttatctaaccagtatatctctttatatttactgaaaatctgttttcctatttaagtattttcaggttctcaataactgcacatgaaattaacagctttcatagtcacaaattattgcaatattttgctgttatactaaatatgggttttttttgtttgtttttaagacagagtctagctctgttacccaggctggagtgcattggcacaatcttggctcactgcaagctccgcctcccaggttcatgccattctcctggcctcagcctcccgagtacctgggacaacaggcacccgctaccacgaaccggctaatttttttgtatttttagtagagatggggtttcgccatgttagccaagatggtctcgatctcctgactttgtgatccacccgcctcagcctcccaaagtgctgggattacaggcactaaatatgcttttatacattagttgacagaatttcaacatataaaatacataaagcaattttcactccagttacaactagcatgctgacctttatttcaaagtaaatacgctaggtgagatagctcatgcctgtaatctgtcatcttagtacttggggaggctgaggcttgagtattgcttgagcccaggagtttgaggacatcctgggcaacatagtgagactcccgtctctagaaacaaatataaaaactagccggctatggtagcttgtgcctgtggtcacaactactcgggaggttgaggtaagaaggtgaaagaatcgctgggcgcattggctcacgcctgtaatcccagcactttgggaggctgaggtgggcggatcacctgaggttaggagttggagaccagcctgacaaagatggtgaaaccctgtctctactaaaaatgcaaaaattagccaggcatggtggcaggcgcctgtaatcccagttacttgacagactgaggcaggagaatcgcttgtacccgagaggcggaggttgcagtgagctgagattgtgctgttgcgctccagcctgggcaacagagtgagacttcatctcaaaaaagaaaaaaaaaggtgaaaggatgacttaaacccagggtgtcgaggttgcagggaaattcagaaatgccactgaagggccaggcatggtgtccaacacctacaatcccagcactttgggaggcagaagcaggtgcatcacctgaagtcgggagttcgagaccagcgtggccaacatggtggaatgctgtctctactaaaaatacaaaaattagcaggatgtggtggtgcgtgcctgtaatcccagctacttgggaggctgagacagaagaatcatttgaaccccggaggcagaggttgcactccgcctgggtgacaagagtggaactccatcttaaaaaaaaaaaaaaaaaaggcactgaagctggtccccagttccctagcattccagaagcaaaatagattttgaccaaataaggagtttgttaaaatttccgattcagtcggagtttgtgttagggtacagtatgaggtacgaatctaataattttttcctggtgggtacccagtggtccctaaaactagaactgaacctgccatctttttaccaatgatctgtgatgccacctttattataaattaaactcttgtctatttctggacctttggttcctttgttcttacaaccagtagcatactattcttcattgttgaggctttatagtagtgcgttctgactctctggtagagctagttccctgatctcttttacagagttcctctgatcattcttgtttcattgtcacaggatctttcaaatcagtccagtttattcccccagtagaaacgtattaagacagtgttaaatttatcagtttaacttgtggagaattaatttctgcatgataatgggtcttcctctttatatactcagtatgtctgcatttctgcaagcattctgtactactctacatattattatgtgaatattttatctttgatatgtcaaccttagggctgttttaactgtttctggtattgtactccgaagtattatccctttgttgttggtagtagtgtgttttttgtttttgtttttcgagacagggtctggcattgttacccaggctggagtgcagtggcatagtcatggcttactgtacccttgaattcctgggctcaagcagtcctcctacctcagcctccgagtagctgggactacaggcacgcatcatgcacggctaatttttttactttttgtagagacagggtctctctatattacccaggctggtcttgaaccctgggcctcaagcggtcctcacaccttggcctcccaaagtgctgggattataggcatgaaccactgtgcttgtccctttgttgtttttaatcggtactgtggtaactttatcctatccactacttctaaagaccctgtgagggtaggtacttgtatgactccatctagacatagtaggatatgttgaataaatgaactgatgcagccattaatcagtgcagttattaatttggtgattgaaggaactgaggatgaaggagatcaagttccgcaatgatactcagtgagttctaggtggaggaggagctgggtgttaactcctgggttcctctccaaacacgtgcttctgaccactgtgggatacagttagcaggttgtgtaaggtctggggacagacacagggtcaataataaaaattgctgaaaatttatagatgtgtgcttatgtgtaaaacatctgttgtgtgcttcctgtaggattttttttttttttttgggaaacattcttactctgttgcccaagctggagtgcagtggcatgatcttggctcactgcaacattcaccttctgggttcaagcgattctcctgtctcaccctcccgagcagctgggactacatgtgtgcaccatcatgcccggctaatttttgtatttttagtagagatgaggtttcaccatgtcggccaggctggtctcgaactcctgacctcaagtgatccgcccgcctcggcctcccaaagtgctgggattacaggcgtgagccaccgtgtccgggcctgtatgacttcttgccaccccttccccaccacaatcctgcatgaaggttactattactatccttgttttgcatgagagaaaactgaggtgcagagaaggtggttttcccagaattataacagattgttttcttacagcacttggcagtgcctttaccacagtgtttatgcccttcacaagaaggggttgtgagcagggcagctgggctggtactgggcattttgaacttccactgagaggttaaatatgatctcttccacctgcttaagtgcatcttatgcctggcacaatgcctcatgcctgtaatctcagtaactcaggaggctgaggcgggaggatctcttgagcccaagagtttgagattgcagtgagctgtgattgtaccactgcacttcggcctgagagacacagcaaaaacctgtgtcttaaaaaatcatgttgttatatgtgtttattaggttattattattttgagatggagtctcactttgttgtctaggctggagtgcagtggtataatctgggctcactacaacctctgcttcctggcagttctcccacctcagcctcccaagtagctgggattacactacaactggctaatttttgtatttctagtagagacaggattttgccatttgcccaagcttgccaggctggtcttgaactcctgatctcaggtcttccacctgcctcggcctcccaaagggctgggattacaggcatgagccaccttgcccagtcatattaggttatttttaatgctggttggcattgtgagcttgcaagagaagatggagcatagtggtcttctcaaaccaccaaatgccacatgcagtcctgatagggctttggcttattgctgagtgctgtgtgggcagcatcttatttaatcctcatgacagcctcgtgcaccccatgagctatgatgagtcccattctgcaggtaaagagcccatgccccagaaggttaagggacttggcccactctgtggcatctaggaagtttggggctgggacttgtgcccaggtgtgtctgacccttcgcacctcctggatccgcggtgctggagggatgctgcggtttgtcctcttggataactctgcttttctcttcgccagcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagaggtcaggaggccttggtgtcttcaccagcatggtcccctctccctacctgagcaacatcttgtcccacaagctctcccagcattatctttacagggaccccacaccctgctctgcacccaggttgtctaatcagagggtgtcggactgcactgggcagactcttgccttgggccctggctggagctgagaacagtcagacatccagccctgtaagggccccttatgggtatttagagaaatagctttggggttcacagatgaagtccttgtattgggattctgcctctgggcagcagaatttatttccagaaagatgcttcctggtctgtaattcacaaacacagcaaactaccctgatgctcagtaggaacagagagttttgtggggagatctggcacagtggctcacacctgtaatcccagcactttgggaggccgaggatctcttgagcccaggagtttgagaccagcctgggcagcatagtgggactccatctttacaaaaacatttaaagattagctgggtgtgatggcatgtgcctgtagtcccagctactcaggaagccaaggtgggatgattgcttcagcccaggaggtggagtatgcagtgagctatgatggcaccagtgcactccagcctgggtgacagagtgagaccctgtctcttaagaagcaaagatgttgtggggagaaatttctggtggaattgccagctagcctattatttttgtgacttgatggcaaccaatatatttggctaaaactttgaaacctcatcagcatttgctctttttcagttggcacttccagaggtagaatgttgaaactgtaatgaggcatttggccaggcacagtggttcacacctgtaatcccagcactttgggaggctgaggcaggtggatcacctgagctcaggagtttgagaccagcctggacaacatagagaaaccccatctctactaaaaatagaaaacatgagggtatggtggtgggtgcctgcaatcccagctgctcaggaggctgaggcacgagaattgcttgaacctgggaggtggaggttgtagtgagccaaaattacaccattgcactccagcctgggtgacagagtgagactcttgtctcaaaaaaaaaaaaaaaaaaaagacattcattagtggattgtccaagttgtttttacctttttttttttttttttttttttttttgagatggcgtcttgctctgttgtccaggctggagtgcagtggtgctatctctgctcactgcaacctctgcctcccaggttcagcgattcccctgcttcagcctcctgagtagctgggactgcaggtgtgcaccaccatgcctggctaatttttatatttttaatagagatggggtttcaccatgttggccaggctggtcttgaactcctgaccccaggcgatctgcctgcctcggcctcccaaagtgctgggattataggggtgggtcactgttgctggcccaattaattatttataacgtcgatttgctttctaatgtgtaaccagtaggtgggggataaaaagtaaaaattcttaagtttaataaagtagttgttcctagatgtccatcagtaatgaagtggttaaatgaagtacatagatgtattttgtgaaatgttaatggttaaaatgaacagtagatagaaatgttgtggtagaaagattgccaaggctaggcacagtggctgatgcctgtaatctcagtgctttgagagacggacgcaagaggattgcttgagcctaggagttcaagatgagcctggacaacatagtgataccccatctctacaaaaatgaaaattgtaaaaattaggcctggtggcatatgtctgtagttccagctacttaggaggctgaagtgggaggatgacttgagcccaggagttcaaggttacattgagctatgattgtgccaccgcaccccagcctgggtgactgagtcagaccctgtctctaaaacaaaaatcattgccaagacataccactgaagtggggagagtaagtcatacacaggacaacatattgtatgtttccagtaatgcttaataaaaaattttcttgttttatgctcagtagatacatacatatgtataaagtttatgtttgaaaatggagagaacagctgggcgcagtggctcacgcctgtattcccagcactttgggaggccaaggtgggtggatcacctgaggtcaggagttagagtccagcctggacaacatggtgaaaccctgtgtctactaaaaatacaaaaattagccaggtgtggtggtgcgtgcctgtaatcccagctacttgggaggctgaggcaggagaatcacttgaacccgggaggcagatttacagtgagccgagactgtgccactgcacttaagcccgggcaagagagtgaaactccatctcaaaaaaaaaaaaaaaaaaaaattcagagaacaatggttgaaaagctctcccacatgttatggtgatgatgagtgaggaggagcatttggggatagtctggaaagcatactttatttatttttgagacagtcttgctctgtcacacaggctggagtgcagtggcgtgatctcagctcactgcactcactgcttgtcccccaggctcaagcgattgtcttgcctcagcctcccaagcagctgggactacaggcgctcaccaccacgcatggctaattttttgtatttttaatagagacggggttttgccatgttggcctgaaaattcctgacctcaagcaatcctcccatctcgacctctcagagtgctgggattataggcttgagccagtgcaactggcctttttttttttttttcttttttttttttttttttttttttttttgagccagaggtctcactctcgcccaggctgaagtggtatgatcatggcttactgcagcctcgacttactggattaatgtgattcttacacctcagcctcccaaagtgctgggattacaggcatgagtcactgctcccgggcatattttcatttagtgttctaaatacactgctatgttggaattgttttttcaataataaaagcattagtgtgtcactgtcatagctttttaaaaatctgaaaccattttgttagtcaagagaaacatcctgtagagttccaagtctgctaggcaaggtcctgtgggtttccctttatttggggtttctacctggagtgtttcaccccagtaggtcttttttctgactggtatctactgttgaacctctctccctgcaccccaccaaccctaagcaaggacttaaattccctttttgttttttgagacgtagtcttgctcttgtcacccagactggagtgcgctggagcaatctcagctcactgccaccctggcctcccaggttcaaatgattctcatgcctcatcctcctgagtagctgagattacaggtgcctactaccatgctgggctaatttttgtattttcaatagagatgaggtttcaccatgttggtcaggctggtctcgaactcctgacctcaggcgatccacctgccttggcctcccaaagtgctggcattataaacatgagccactgcgcctggctgaggacttgaattcctgaatcctttttctggcacagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggtaagaggcagtagtggagtctgatgaaatggaaaccccacccagagcgggtggctgccactctgcagctacgaggattggcccttcatctgcagctttttccattcttcaaagccagaaatcctctttttttttgttgggtttttttttttgagacaggatctcactctgttgcccaggctggagtgtagtgacgtgatcttggctcactgcaacctcttcatcgtgggctcaagtgattctcccacctcatcctccggagtagctgggactaaaggcacctggctaacttttgtattttaggtggagacacagtcttgccatgtcgcccaggctggtatcaaattcctggactcaagtgatccgcccacctcggctgatcccaaagtgctgggattacaggtgtgagccaccgcgcctggtcaaaaatcctcttgttgaatataaaacctcccaaatttgaaatgtcactgaccaaatacaaaaaagtaaaaagcgttctgtgggtttagtaatacatccaccgagagctagactcagcgtaacgtgtgctgcatgggcagaaaaaaagaatctcagttctcaccccagcccctctgctgacagcttccgatcaggccttttacagcagatattaataacagacagttaaggagtgctcagtgtgtgctggccagcctgcagccttcgccgcaggcccaggatgcaggtgctgtccccgtttgatgaaagtgaggctctgagttaagcagagtcatgaagcaattgaatggcagatggtttgggattcagacccaggcaggcaggctccagggcttaccctaccatctactaccttatcccttagcttgtcccctgggcatgaagagaccagtgagacttctagaattccggtgcagagcccttctgtttagttttgttgagatggagttttgctctgttgcccaggctggagtgcaatggtgcgatattggctcgctgtaaccccctcctcccaggttcaagtgattctcctgcctcagcctcctgagtaagcttgaattacaggtgcccaccaccatgcctggctaatcttgtatttttagtagagatggggtttcaccatgttggccgggctggtctcaaactactgacctcaggtgatctgcctgcctcagcccctgaaagtggtggtattacatgtatgagtcactgtgcctagccccagtctagagccattttgcatactttatttcattgttgtttttagagacacagtcttggtctgtggcccaggctggagtgcagtggtgcaatcatagctcactgcagcctccaactcctgggctccagtgatcctcctgcctcagcctcctgagtagctgggactagaggcatgcaactccatgcctggctatgtttccacacttcaatatgcatgtagcttacctggggatcttggtagaatgtacctcagatcaagtgggtcttgggtggggcctgaaatttctttctctctttttttttttttttgagacaaagtcttgctctgtcggccaggctggagtgcagcggcattgatcttggctcactgcagcctctgcctcctggattcaagcgattctcatgcctcagcctcccgagtagctgggattacaggcaggcacctgttaccatgcccagctaattttgtatttttagtagaaacaagattttgccatgttggccaggctggtcttgaactcctgacctcaactgatcgaactgcctcggcctctgaaagcactgggattacaggtgtgagctactgtgcctggccgagagattctgcatttctaacagttctcatgtgctgctggtgcatggaccccacttggagaagagaggctctgcagagcgggacccttgtaaagctggatcatcctgtctatagttcttgtatctatcacagatgccattatgttaattaactatatggattttctacaatttcaaaaggatttgttttgggtttgtttaaaaagactaatgtggctgggcacggtggctcatgcctgtaaataccagccctttgggcggccaaggtgggaggatcgcttgaaactaggagttcatgatcagcctgggcaacatagtgagaccctgtctctattaaaaaaaaaatttgttaaaggccaggcatggtggctcacgcccgtaatcccagcacttttggaggccaaggcgggcagatcatttgaggtcaagagttcgagaccagcctggacaacgtgatggaactctgtctctactaaaaatacaaaaattagccgggtgtggtggcacatggctataatcccagctactcaagaggccaaggcaggagaatcgcttgaacctgggaggcggaggttgcagtgagctgagatcacatcaccgcactccagtccgggtgacagagcaagactaacatgtaaaaataagtatttgttgcagtcatcacaaggacttgaaaaattggttgtcatacgggccttgggtgtgtgatgcggttaactacggaaagaaatagggtagcttttgggatccgaggaaaggcgtcagtgtccctcctgtcccgtggttttggatctagcgatgttaacgcacagacatgactataggttggtgagttacatgctcttccctttgcacacccaggcctggacgactccaccggggggacccccctcacacctgcggcccggatatcagccctcaacattgtgggagacctactgcggaaagtcggggtaagaccacactttcctggcgtttggtgccttcctgcctgtctttcaggatgtgtgaagggggttgatctagttccttccctctcttctttttttctttttttttagagacagggtcttgctctgttgctcaggctggagtgtagtggtatgatcacaactcactgcagcctcaaaatcctgggttcaagcgatcctctcaccttagcttcccgaggagcttggaccacaggtgtgcgccactatgcctggctgatactttcatttttttgtagtaatgtgggtatcgctgtgttgcccaggctggtcttaaactcctggcctcaagtgatcctcccaggttggcctcccaaagttctgggattacaggcatgagccaatgcgtccagcccctttcatagcagtgtggtgagttttaggtgtggctgctcctttagcatccctgggaatcattagagcttcctgtgggagttactgccagacactcagagctctgactcgaagccctgctctgaaccctatgtatgtctctttccttttaccgtttttcctctaggaaatttgggaaattagggtgatatgtgtgttttttccttaactcgaaaaattaaggagcacttggaaactgccttctcttttggccgggtgctcatacctgtaatcccagtgctttgggaggccaaggtgggagattacttgagctcaggagtctgacaccagcccgggcaacatggtgaaaccccctgccccgacttggcctctacaagaatgcaaaaattagccaggcctgatggtgtacactggtggtcccagctactcaggaggctgagaggtgggaggattgcttcagcctgggaggttgaggctgagtgagctgagattccaacactgcactccatcctgggtgacagcacgacgttgtctcagaagagaaaaaaactgccaccttttttttttttttttttttttttggtttgtttcttggggtttaagtgaattttgacactttgggagaccgagatgggtggatcacctgaagtcaggaattcaagaccagcctggccaacatggtgaaaccccatctctactaaaaatacaaaaattagccaggaatggtggtgggcacctgcgatcccagctacttgagaggcttatgcaggaaaattgtttgaatccgggaggcggaggttgcagtgagctgagatcgcaccgctgggtgacaaagtgagacttggtctcaaaaaaaaaaaaaaaaaaaatcttgaaagcctagggcaaagaatttggcctttcagcttttatgttaattacagggagggatccttttgtgcttaagtaaaaacataggtattctttgtagtttatttttaaaaatgatgcctagaaggccacataatttaactcctaccaagttgtcactgtacacagtgtatttgtagctacaacttaatagaagcttgcaactcatttcttttgtttttacttctggtttttggctgtctggtttgctattctagaagcaggtctgcatttcagtatttagcctagttggagtatagagaagcctggggtgctgtcagtgtccttttggtttcctcagggtctgttgtagccagaccaagtccttaccaaacttcttgccattctgcagaggtttaacaaggtaaaccaaagggtgaaggattccagaagtggatttcctacttcctacaagcggagttggataattggtaggttagtgatttttccagaaagctcccattttaaaaaattttttgtaattaaaaaagaattttttttttttttttaagccaagcatgattgtgcatagtcctagctattcaggaggctgaggtggaaggattggttgaggctgcagtgagccgtgatctttttccaggcagctcccaaacattttaaaaaatttttcgtaattaaaaaaaattttttgcattaaaaattttttttattaactgggcatgattgcggatgcctataattccagctgctcaggaggctgaggtgggagggattggttgagcctgggaggttgaggctgcagtgagctgtgatctcaccagtgcactccagcctgggtgacacagcgtctaaaaaagtaaaaaacaaaacaaaaaaaaaaactgagatgggatcttactttgtggcccaggctggtctcaaactcctgatgtcaagccatcctcctgccttggcctcccagagtgctgggattataggtgtgagccattgtgcccagccagctcccaaatacttaaggtgcttggttctgagactggcatatacgttggattcctcttggggtcccaccttggaattccagtgcacaacagtttgagaaccactgtctggggttcgttcttctgtacaggctctggtaagacagaatagtccttgcctataacttgagagataaaagtgtatttctgtccaggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggtcagtaccttctaataaacctctcgctggcggggagaacccgcctgccccaggcaagagacactcacccccagcccacagccatgtgtctttttaaattataggattatttcagcaaaccttatcctctcctctgctccctgcaggcagcattaggtggtgtcttgtggcttgaacaaagggctagagagagggtcttgttttgtgagacagggtctcactctgtcacctaggctagaatacgatggcaggatcatggctcaccctctgcctcccagctcaaacgatcctcccacctcagtcccccgagtagctgggagtacaggtgcgtgtcaccgtgctcggctaattttttgtattttttctagagacaggttttgccatgttgccgagtttggtctcaaactctgagcttcaagtgatcctcacccttcatcctcccaaagtgctgcgacgacaggtgtgggctaccatgcctggccaagaaggtcatttttatcatttgattctacagctgctactcacggttacactgtgagaatgtcctgtataaaagcccttatttgggccaggtgtggtgacgctcgcctgtaatcccagcagtctgggaggccaaggcaggtggatcacttgaggtcaggagttcaaaaccagtctgggcaacattggtaaaaccccatctccaccaaaaaaaatagaaaaatgagccaggcatggtagcatgtgcctatagtcccagctactcaggaggctgaggaaggagaatcacttgaaccctggaggcagagattgcagtgagccaaaattgtgcctctgcacagcagcctgggtgacagagcaagactccatatcaaaaagttaattaattagttaaataaaaataaagcccttatttggggaattgagcatcagtcatggctctgcttcccctgaagtttttttttttgttttgttttgttttttttttgagacgtcttgctctgtcgcctaggctggagtgtagtggcatgatctcagctcactgcaacctctgcctcccaagtccaagcaattctcctgcctcagcctcctgagtagctgggattacaggcgtgtgccaccatgcccagctaattttttgtatttttagtcgagacggggtttcactgtgttaggatggtcttgatctcgtgacattgtgatccacccacctcggcctctcaaagtgctgggattacaggcgtgagccactgcaaccagcccttttttttctttttaaatctgtagaacctttgagaaactggcactaacttctagcccagactatgttcctgaaaccagccacccgatgggacagtgcagatctgatctctaacagtgtcattaattttcttgcctaaagaaaatcagggccaggctcagtggctcacacttgtaatcccagcactttgggaggctgagggcagcggatcaattgagctctggaggttgaggccgcagtgagccgtgttcccagccactgcactccagcctgggtgatgaagcgagaccttgtctcagaaaaaaaaggggcagctttcagattcaggaattctgcaaggtgtgtgactaccatctctctgggccccaagccgtaggaatttgatgggtttgtagcagacacgtgacaggaaattaagaatattttccatggcatgcacataactttgagacctttacacgtggatttttaggccaggtgcagtgaagtggctcacacctgtaatcccagcactttgggaggcagaagtgggtggatcacttgaggccaggagttcacaagaccaaactgggcaacatggtgaaaccctatctatactaaaaatacgaaaattagccgggcatggtcgcggatgcctgtagtcccagctgcttgggtggctgaggcacaagaatcacttgaacccaggaagtggaggttgcagtgagccaagattgcaccactgaactccactctgggcaacagagtgagactctttctcaagaaaaaaaaaaaaattaatttttgtttgttttctttctacgagacagggttttgctgtgtcacccaggctggagtgcagtggtgcgaccatagctcactgcagcctcgtcctcctgggctcaagccatcttcctgcctcagcctcccaagtagctggggctacaggtgcacaccaccacccctggctaattttttttatattttatagaaacagtcttgctatgttgcccagactggtctcaaacctcctggctttgagtttgagaatacacctctgagactgtagtctgcttctcattgagatttctagaggtgagttttcagattaattttccaggcgatcttcccaccttgacctcccaagtgctgggggttacaagcgttagcaatcatgcctggcctttttttttttttggagacagggtctcactctgtcacccaggctagactgcggtggtgtgatctcggctcactgcaacctccgcctcctgggctccagcgatccttccacctcagcctaccaagtagctgggactacacatgcaggccaccacacccagctaatttttgtttgcatttttcatagagacagggtctcactatgttgcgtaggctgtaaaacaaacaaacaataggtaagagatggatttttctagtgggtctgagactgggcgttttgtgtgaccttggaatctgagagccaggtagccagtgtcctcttcttcatttcacaggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttgagacagagtcatgctcttgccctgtcttgtccaggctggagtgtagtggtgcaatttcggctcaccgcagcctccgcctcctaggttcaagcgattctcttatctcagcttcccaagtagctgggactacaggagtgtgccactacacccactaattttgtatttttagtgagaaacggggtttcaccatgttggccatgctggtcttgaactcccggcctcaagtgatcctcccgcctcagcctcccagagtgctggaattacaggcctgagccaccgtgcctggcccctgattggtcttgacaggtgtttttaatgtcccaagtctccgtaaatgtgggatggagcttctctcagaggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccaagattgcgctactgtactccagcctgggcaacagagtgagactccgtctccaaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaagatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgggtgggtggtggtggtggtgtgagagacaaggtgttactgttacctaggctgcagtgcagtggcgtgatcatagctcactgcagcctggaactcctggctcacatgatcctcctgccttagccttccaagaggttgggagtacaggtgtgcactatcctgcctggcttactaacaacaacaacaaaaaaacaccttttttttatagagacgggggtctctctcggctaggctggcctccaactcctggcctcaagtgattttcccatctcagcctcccaaagtgctgggattccaggtgtgagccactgtacccagccaccatctgacgttttgtggaaagtgtttgctgactcattggacaagaccttgtgttttaactcaaaaaatcaaggaaatcctgtatttttcttaagatactggttttgatgagtcaagatgttcttcccagtcatgttcgagggcagggggcagtggcccttagaccacacatcaccttatttctctcccctgccctccctgctgagcggcccagtaacccccttagacagtctcactttgcatctctgctctgctctctggctggctgtggggttgtaggcaattgatttcacctctctaggcctcagtttctgcattcatgacgttaaccctgacttcagagaatctttgggacgatgaagcaaaacccagccttccccaactccttttcctctatagaaaacagctcaacagaaaagccaacgacattgtgatttataaccatttattagtgaaagtgtttttaagcacagtcagggtgtaaacagtgcagcattcctgctcccctccgtgggagcagcgtctccttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggcacccatttcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaacttcaatttttaccttgaatacaggggtagtaggggtggtggtggtggtggtggttgagacagggtctctgttgcccaggctggagtgcaatgatgcaattatagctcattgcagcctcgaagtcctgggctggagcgttcttcctggctcagcctccctagtagctgggaccacaggtgtgtaccaccacgcccagcttatttttaaattcttgtatagatgaggttttactacgttgcccaggctggagggtggtggtttttatattccttgtgtgaggggtgtctgtgatatttggaatttgagaatggatttagacaatgctaagtacagtctgctgggttttgctttgttctgggttgttgttgggttttttttgtttgtttgttttggtttttggttttcttgccgtggtgcaaaactgtagaaagttgcttattcactggccttggttccattgaagtctgcgtctcgagtgtccgtttcctcctcagaaccatctgcattttcaataactctacgtcctccagaccttctagaaggaacgaaagaggtctcgtttcctcgcctgtgggttgtaagaaaacacattatttagcaaagaaatcttcatggttgggatagattttttataaatctattttaaacttgtagctatagtcctattgcaatataaattttttttatggcagaaaacacacacggcacaaataagatgcagatattcaagttgaagtcaacaaatcattgccagtcttaaggcatgagtgattgaatttaatcagctgaaattggttgcgggggtgggtggagaaggtttttcaaagcaagacgatctgcttttcaatatgtcaggcttggtcatttgagaagccacaggattctggtctgctgtggtctttgatttagaataggaaaaaaacgccaaaaaccaagcaggggattttgtcttctgactttattcatagcccatggggcagagttgaagagagaacatactgtttttcttctgtatctcctcacccccattcgccttagaggtgagttttcaagatttgaattggaagaaggtgaaatggacaagggcagccttgagaaggacacagaggggctccctggttaaaaggcgagacagcaccccctgctggtgtgaatgttcatggactgagttttccccactgcagggactgctgcatctgttttgctgatcgtggaacataccgcacatggcgtaaaacaggtgcccagtgaatattagaaaaggaaattatacgtgttaatccaaggtggattattttattaaattgagatgaggtcttgatattgttgcccaggctggtctggaactcctgagctcaagcagttctcctaccttggcctcccaaagcgctggcattacaggcgtgggccaccacacctggccttcaaggtggatttaaaaaagaaatttaagagtctctctcacccaggctggagtgcagtggcatgatcttggctcactgcaacctctgcctcctgagttccagcagtccttgagcctcagtattgagtagctgggactacatgcacgtgcacactgccacgcctggctaatttttgtatttttagcagagatgggattttgccatgtgacccaggctggtcttgaactcctggcctcaaacgatccacctgtcttagcctctcaaagtgttgggattacaggtgtgtgccagtgcacctggcctctgaggtggattttagctccagccagtaggacacccctgtctctccttaatgctgccatctcctctctgcgctggttctctcttgagtttatcacctcgacttcacaggaagggctggtcacgtgaggggagactttgggtaggaggaagagagtgggcagaagaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtgaccaattctttagtcaaaaggaacaactcggctgggcatggtggctcacacctgtaatctcagcactttgggaggctgaggcgggcggatcatgaggtcaggagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggtgagactccgtctcaaaaaaaaaaaaaaaaaaaaatcaaggcccagagattcatgatcactgagaagaggaattcgcaaatgacccttttgttgacagaggatgggagagaccccggctgggaaagcccacctggctataaaggatgggacttcccgcagtgcagcgatcaggaataaatacttaaagctgcagccacttcaaagtaaacactcctagcccagcttcacagagaagcttctggacttgcagccctactagagaactctccatccttctctctctagatgtgacccttaagtctttttcttttttagcactgttttccaagcgcttgactcagaaggatgctcaaattcagcgcagaggagcagcagtttgactgttccctgtacgctccccacacagctctcttcgtcacagttttaactccaggttcaaaccctgatgggttggccagttgctgcgactcatgcctgtaatcccagcacttggggaggccgaggtgggcagatcactcgtgaggtcagttgttcgaggccatcctggccaatatggtgaaaccccgtctctactaaatatactaaattagccgtgcgtggtggcaggcgcctggaatcccagtcactcaggaggctgaggcaggagaattgcttgaacccaggaggtgaaggctgcagtgagccaacgttgtgccactgcactccagcctgggaaacagcaagactgtctccaaaaaaaaaaacaaaaaaaaatctgatgagctgggaagtagtccctaacctccacatcagtgctctaggcactctctttttggctcttggaagagtctatttgctaactggaaaagcttaatggataaatttgctcccttgacctaagaaatacattgtgccctgggccgttgaagctccttgcttggctgtcagcctgcaagatactctgttttggctgaagtgcttttcttggaactggtttcaaatcctagaccaaggttgacaccaactatacctgttacaggaactaagggacccccctaaaggttttcttaaagggtctgatcctggagaatctggaatttttttttgaaatagagtctcgctgtgttgcccaggctggagtgcagtggcgtgatcttggctcactgcagcctctgcctcccaggttcaagcgattctcctgcctcagccttccaagtaactgggactacagacatgccaccactcctggctaatttttgtatttttaggagagacggggttttaccatgttggccaggctggtcctgacctcaagttatctgcccgcctcggcctcccaaagtgctgggattataggcatgacccactgtgcctggcctagcatttggattctattcgtggactcagcttatccaaggcctcgggaatcatcttgagtgtaagcacctgctagtttgcaaggactcagtttcccactgaccagtgggttctgcacttcagcccaccctggaatttggcttatcctatgatcccaatcagctggtaggagagctgcttgaagtgtcctagaaactcatctgctcccccacaaaactggctcttaacaagacctcaccctgcgctttaagtattttggtagtgacagcaaagctgagattctccaaaaatgaagatggacacaaatgagggttggtttggcctctccatgaggtgaagtcagatccacatggcctaacttcacctgtgaaaagttggtcatgcttgtaatcccagcatttggggaggccaaggcgcgcggatcacctgaagtcaggagtttgagaccagcctggccaacatggtgatatcctgtctctaataaaaatacaaaaattagctgggcgaggtggcgggagcctgtaatcccagctactcagaaggctgaggtaggagaatcgcttgaacccaggaggcaaaggttgcggtgagccaagattgcgccattgcactccagagcgagactccgtctcaaaaaaaaaaaaaaaaaaaagcaaaatcccagagcagcagagacctcttcatgctttcttgggaagggccctgtgtgcatccttgagtcttgggtatccactccccagtccctgaacatgtacatgcccgtgaagcctccagaaaaggctctgccaggactgtgcttggctttgcggtggtcagcttccaccccgtgtgctgaaaatgcagtttgtagctagacatcactcaagccacgtgcagcccccggcatttgtcagacatcgcagtgagctcatttccttcgcagacaagcctgtgaaagctgaatcatgggaggactggttgccgcgccgcagttaccgtgaactttgtgatctctgacttgtgacccagaccagccaactagaagccaagtacgttctccaggaatgtgcccagatagtggaactgtcatattcattcagtgcagtgtcttcactggacaagggaggacagcactgctgagtgccctaaccacgtaagagtggcttttggcatgaaaggaagaaaaatccaagctacacacacagcctctgccatctcgtcaagatgcagtgataagggcgcacactgttgggtgtcatgtcacatgtgctgcccagaggcaggaaggacagtgggtcaagagatgaggtctatttgtcatcctgatcttggtttcaatgaaagctttgcacaaagatatccaagcctccagattttgcaagaatctcgtggaaatgtgcaagggtttaaaaattggggtgggcagaggggcgcattgggcagaaaagaaatggatactgagacaacacacagctgcgaagctgaaggcatgatacctggtgcatcactgcgaagtttcctgtggggggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcaggccccacgtgcttggctaatttttgtatttttagtacagatggggttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctcactgcaacctccacctcccgggttcaagcgattctcctgcctcagcctcccgagtagctgggattacaggcatgcaccaccgtggctggctaattttcatatttttagtagagacggagtttcaccatgttggccatgctggtctcgaactcctgacctcaagtgatccacccacctcggcctcccaaagagctgggattacaggtgtgagccactgcacccggctcagttttttaaatggaaaggaaaatgtctgtcctttagagctacttttaagaacctcctataaatcccatgattgcatactggttcagggaagtaaaagcatttgagcaagctagtttgagaaatcagtgttggaacagaagccaagaagtcccaggcaaggaacctgcagccgcctgtcccttggtttatgattacttgctcttcattagctttcgggcctctagcaagagaggagaggtggaggccttgtacagctcttgccggaggtaactggcagtgtagccagtggtaggtaagtgggtctggctttagagagggcttgtgtcgagatgcgtctggctgatagaacttggtgaaactcgcactacagttccttcttggctgaggagccaggcatgcttaccaacctccctcagggctctagtgcctgattttatgtttttgtgcacccaaaagatgcagaaggcaggacagaccttccacctgcattatgtgtgtattcgtgtcggaactggcaaaaatggtctttttgttccactttgcccttggctgcccaagaaggctcaagtgtctggggcagaacccacaggaggtgtccagtgtgtgctaaagaatcactgggccggccgggcatggtggctcacgcctgtaaccccagcactttgggagaccgaggcaggtggatcacgaggtcaggagatcgagaccatcccagccagtatggtgaaaccttgccactactaaaaatacaaaaattagccaggtgtggtggcacgcacctgtaatctcagctacttgggaggctgaggcaggagaatcgcttgaacctgggaggcaaaggttgcagtgagccgagatcgcgccactgcactccagcctggcaacagagctagactccgtctaaaaataaataataaaaagaaaagaaatcactgggcctgagaaagggaagcagagacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagtttcaccatgttggccaggctggtctcgaactcctgacctcaggtgatcagcccacctcagcctcccaaagtgctgggattacaggcgtgagccaccgcgctttgccccaggagtcttcacagtgagaacagctctcctccactgacccctcaaccctgggagatgcttccaggcccctgctgtactttgggagcctaggcctggtttctctcctatccatgggggaccaacaagcgctcaccatgcagcgagtggggcttttccctgaaggcttggtgccctgcgccagctgctctcttccccttctcagaggggtttggacttttccctgtctcacgcagtggtccccaaactctagaggtgatttcagatggcttccgggcatgccatccgctaactgaactgggccctgagaaagtcatttcctttccaactctttttaaacaagtctaattatgatgtcagagagagtctatttggtgctaatggctgttgtcactccctttttagtggagaagtaggcttcaggtcttggtgatcaagttgtggccacaatagctagatattgaacttgatactatttttatcatattactttcatcgtaaccagttgatagaggtgatgctggtttaaaaatatagaggaggtatgtttatttgccgttatattcatgtatgattaaaactgttaaaagatcaagtcattggtattaaaggtagtaagaggctcagcacatggctgtggtggtatgagaatgaagcggggaaaatatctaggacccgagggataaaggttcactctgcctggtgctgtcctagacactggagattttttttttgagaccgagttttggtctgtcacccaggctgaagtgcagtggtgcgatctcagctcactgtaacctgtgtctcccaggttcaagcgattctcctgcctcagcctccctagtagctgggattacaggcacgccccaccatacccggctaatttttgtgtttttagtagagacggggtttcaccatgttggtcaggctggccttgaactcctgacctcaggtgatcagcctgcgttggcctcccaaagtgctgggattaaggggtgagccactgcacccagcctgggcaggattctttagggaaagttgaccagattctcccatagatgggatgtggggtataaaggagaccaaaacgttaagaaggaccacgaggtttgtgatgtgaattgttggcaacttcatcattttagctgctgagctggagagaggagccagtttgggggtgaagagtttcagtcaggacttggggtgcagcatgtttggtgtgagctgcctattagacatccatgtgggaacgggagggtggtctgaggttctaggaagaagctagggcttctcagagatgaactgaggagtcattagatatacatggaattctaaagcgccaagattagttgagacctctcacctagcgctggggagagatgaaaacaactaaggccgtgcagtggtccatgcctgtaatcccagcacgtggggaggctgaggcgggtggatcacaagatcaggagttcaagaccagcctgggcaacatggtgcaaccccatctctactaaaaatataaaaataggccaaaaatagcttgaactgggaggcagaggttgcagtgagctgagatagtgctactgcactccagcctgggcaacagagcaagactctgcccaaaagagaactaagttgataccctggggcggtctagtggcaagcaggtttcgaggtgagggatcagcagaggagaggaagagggacaaccccacaggtcgggggacaagcaggtgtggatggtgtcggggaagtccagggaagcaagtgaattaggccagaggcatgatggactgcgtcacgtgctgctgccctgtcaggggacctctggccattagtgtcacccatgggaggcttctgggagagtgatgggtgggggcgaggggaaccagcaactcttcacatacagtttttttttttttgagaccgagtctcactctgtcacccaggctggactgcaacctctctctcccggttttaagccattcttgtgcctcagcctcctgagtagctggaactataggcatgcaccaccacacctggctaatttttatattttttggtagagacagggtttcggcattcacatccagttttgtagtaagggtagcaaggtagacatggggctaagaggttattccatttgctgatggagcaaatgaaagagaaaaccttgcaaaataaggatttttggagctatgtgcttgagtgaacaagagggtcgggtccaatggaggtgttggcctcggttggtgccagagggttcagcatagaaatggaaaaaaaatagaagtgtacagaggtgcacggaggtaggatgatgaggcagtgggagcttgtgcacgtttcatgatcatttctgcttttgagttaagtaggaagtaaggtccccagctgagagagaatggggaggagcgatcataagttcaaagaaaaagtgaaaagcagcagagagtgagaagatgagggaggggtgtgggaggacccctgagcaaggcctgctctgtgggaaaaggtggagagtgggttttgggttttttgagacagggtctcactctgtccatccagggtaagtgcattggctagatcatggctcactgcagccttgacctctggggctccactgatcgtcccacctcagcctcctgagtagctgggattttaggtttgcgccatcccacctggctgatttttgtttgtttgttgtagagatggggtcttgctgctcttgaactcctgagctcaaagcgattcacctgccttggcctcccaaagtgctgggattataggtgtgagtcccgtgcccagccaagcttgagtttcatttgggttgtgctttcaccaaatgattgcagcaatgcaagagggggaaccggatgttgaggatgcgcgacgggggttactagacagctggtttggagctgggtcagaggctgatggcattaatggagtgaagaccccgttggggacagagccaaagaaaggtggcaccaggcagacaatgggatgcctgagggtcaaattgtgagggctcctaggagtactggttggcccggtagaagcagcaggatcacccagagggtcaaggaaccgagaggctgcgtcgcccacctggatgttgaaatcatggagaactgtgaggagtggtgtgggagacaggaagcccggagctaaaacctcctgggagccaatcgggatggatggacagggtggtggaagcagcccttgggagcaggggggacccccaaggtaccagaggcatgggagagaaaacagcccccactccagtgacagcaggaattctcagcggggtggcagtcgtaccctcccatctctagaggacttctggcaacatctagagacatttttggttgtcacattgcagggtggtgggggactactgcagccggtgggtagaggccagaaatgtaagcacctgctacttttcagggatctttttccttctgatggggaatgtcggacagcccccatacccgagaataatgcagcccagatggcagcagtgctgagggggagaaaggaggagcagagcatgtcaggaaggaggtgaagtggcggggggtggtgttgcagcttcaatggatgtcgtgaagactcagtgatgcaatgaaggaggggctggaggagacagtggggatagcctcttcctcctcctcagccggaggaccggatgggagacggtcgatcgttaaaggatctagaaggttagctgctaccaggcaaggcagggcccgggtctgatctcagtgcctggcccacactaagcttagtgattaaggagaagcaggaataaaccacagaagggagtggcggctgtgggcacaaggggcatttgcaggccgaaaggagcccgagcccccagtgcttttctctggcctgagagacggggtcctcccgggccacgggctcctcacctgagcttgctcttgagtgcgttcacctcgcggcccatggcctcgttgctctccgtggcctcatccagctcccgctgcagcttcctgcggttggcgttgatgcgctgggactcctcctctgcctcctccagctgcctcttgagctgcttgaccctggcattgcctttctctgcctgtcgcggagagttggaggggtggttaggggaggccggctgggggctgggggctcgagggaggctgggtggcaggggctacctgctccttgtactgctcggccatcttgcgctcgtcctccacctgcagcaagatttccttcagcttcttgtctttctgcttcagcgacttggtggccgcctgtttctctctgcaaacagcaaggaaaacaggtggtttcagcggagggtggcaccccttgtagctggtgtgtcacctggaggtggcatcttgagtgctttcctgagccccgtatctggactcctctcaagaatcagtcagatggtggaatagtattcagccatgaaaaggaataaagtatcaatgcatgccacagcatggatgagcctggaattcttgccaagtgaaagaagacacatagcagacaacatagtgtgtgattccgttgatatcaagtgtccagaatagataaattcatagagacagaaagtagattatggttgccagggactgaagggagtggttacagggcatggggtttctattttttttgcggggaggaggcaaggtcttgctgtgtgacccaggttggagtgcagtggtgctccaatgcctgctcttcaccctagttcatagttcactgcagccttgaactcctggctcaagcaatcctcccacctcagcctcccaagtagctgggactacaggcgtacaccagcatgctcagacttttaaaagtttttcatagaaacggagtctctggccaggcgtggtggctcatgcctgtaatcccagtactctgggaggccgaggtgggcagatcacctgtggtcaggagttcgagaccagcctggccaacatggtgaaaccccatccctactaaaaaatacaattacaagctgggtacagtggtgtgcacctgtagtcccagctacttgggagggtgaggcggaggttgcagtgagctgagatcgcaccactgcacaccagcctgggaaacagagtgagactatgtctcaaaaaaataaaaataaaaaagtcttgctatgctgcccagactggtctcgaactcctggactcaagtgctgctcccacctacctcagcctcccaaagtgccgggattatgggcatgaaataccacatatggcctggggtttctgtttgagccgatgaaaatgttctcaaaatgactgtggtgatcgtttttacatgtttgtgaatatatgaatagcccttgaattatacactttaaatgggtgcattgcagggcgtgcgaattactgaaaaagctactagaagagaatgggtgagaatccttagaatccaatggtaagaaatgtgctgtgatcatatgcctcattcgacccataattaagaaggcttccagtgtgtgtaccaaatgggctgccggttggacttttgttttttggggttttttttgtgtgtgtgtatgtgtgtggaagggtcccactgtgtcacccaggctgcagtgcagtggcacaatctcggctcactgcaacctccacgtgtcacgttggagtgattctcctgcctcagtctcctgagtagctgagataataggcatgtgccaccacactcggctaatttttggtacagacagggtttcaccatgttggccaggccggtctcaaactcctgacctcaagtgatccacctgcctcagcctcccaaattgctgggattacaggcgtgagccaccacgtccagcctggttggatttttgatctgtcagcatgctatccctgcagaggctgggaaaagtcatatgtactgctgggaaggcaggttaatgtcaggaggaccatggagatgctaagagcagctcacactttaggtgcttgccctaggccaggaaccagcagggcactttgctgtgtttacgttcagttctcacaacatacctgcactgtaggcatcacagagcttgcttcttacaagccagaactgatgctggaagaggttccctgacttcactatgactcctgctgtccatcacccccctgcaaactgggttcggaactccacacccgcatacctggcctcctgctcgacctgctcctccagctgtgcaatcttggcctccagcgccgcgatggtggacttgaacttggacttgacggccccctccatctcgtggagcttgctccggagctccttgttctgccgctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccctgtcctctccttcatcctgtaaaactccactcaagagcttcttccaggccgggcgtggtggcgcacgcctgtaatcccagcacttttggaagcagaggcaggtaaatcacttgagctcaggagttcgagacctgcctggccaacatggtgaaaccccgtctctattaaaaatacaaaaattagccgggcagtggtggcacgtgcctgtagtcccagctacttgggaggttgaagcaggagaatcccttgaacttgggaggcagaggttgcagtgagccaagattgcgccactgcactccagcctgggccacagagagaccctgtctccaaaaaaaagaggtgcttccacaagtgtcagtgccacccaggctgagcgagtgacttgtcccttgctttctctgtcctggagtcgcctggagaatgatgcctgttcaccctacaccacaaggggctgcaggttactggatggtccctagtgcccaccatggaactagtgctcagtgacatcaccaagggctcactggataaggtcagagcttcagctaggggaaaacgcaatgaaagagcatcccaaggcccggactccagggatggccgtgaggtacggggagccagccacgccgtggctggaaaatgagacactgcagcgtggagaggagtattctgaagacagcagcctgggcactggtgtaagggccctggatctctactctcaggccccaccaccctcttgtccctcaatccagggcctgcacacaggaagccgccacgcgtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcggccatggtgggggcctctaccctcccccgccttaaaagatgccccctccttggagtcatgcctcaggggtattgccctcatcatctaatgggtgaaactgaggcttggagaagattagaagactcatctgtagttacacagccaggaagtggacagccgggactcaggccgggtccgtgtcagcaaagctgggattgggatggggaccagcacactcctccctgactcttcctggcctccccttctccccacacagctacttattgggaatgaatgaaagcagccacacccccaaacaggcatgaaagcgctgacggaaaacctaaccaccatgggtctgtccccaatctcagaggacgcttcgtcagcagcagcattgaaatgggggtccagggccaggcacggtggctcacacctgtaatcacagcactttgggaggccaaggtaggaggatcacctaaggtcaggagttcaagactagcctggccaacatggtgaaaccccacctctactaaaaatataaaaattagccaggcatggtggtacacacctgtagtctcagctactcagaaggctgaggcaggagaattgcttgaacctgggaggtggaggttgcagtgagccaagattgtgccactgccctccagcctgggtgacagaatgaaactctgtctcgaaaaaatttaaaaaataaaatgggggtcgaggatgctgcctgtccccccatcctctgcttcagagccctcttcctccattcagtttcctaccttcccgacaggctactggccagctcctctgccagttcctccttctcgaggtccgcttgtttgcgagccctctcagcggcggcgaggtcctaggtgggagggaggaaggctgttgtctgccagggaaaggccaagccccaccaagagtccaccctgacaactcagccacccttgaaagtacatgttcttcctctgagctcaggggaggccccgtgaatacatagaggagggaagcgtgtgtctttctagacaggtggaccccagaggaggacgaaatgaaatctgggaatgcacagactggagctgccaaggggtgctaccgtgacacccgcatctgaggctctcctagcaaggcgaggctttacctcttgtagctgcatgaggtctgcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccagttcagctttgcacacccaccccttggattttctgcagttgaccacaaagaagttcccattgcacgagcatggctctcagttccaggtggctggtggtgcgctgggagcaccattctgggtgggctccacagacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttcggtggcctgaggggaactgtgccctccctccacccatgccccaagctcctagtgtcacccacctgcagtttgcgtagctgcttgatggcttcctccctccccttgatggcagagtcggcctgaagctccaggtctttcaggtccccttccagcttcttctttgctgcagctgccagggcacgttgctttcgctcgtcttccagttccgtctcatactcgtgaagctgggcgaggaatagagatgtgtgctgccccacttgcccctgggaggtcctttggctcacctaggcagcacatcactgcaccccttccccagcacagcccccttgtgaggtgggcatctcatccccagttgcagatgagaaaacggaatcacgccgggcgtgggtggctcatgtctgtaatcccagcactttgggaggccaacaggagaatggatcacttgaggccaggagttcaagaccagcctggccaacatggtgaaaccttgtctccactgaaaaaaaaaaaaaaattagctaggtatggtggcatgcgcctgtaatccaagctactcgggaggctgaggcaggaggtggaggttgcagtgagctgagattacgccactgcactccagcctgggcgacagagcgagactctgtttcaaaaaaaaataaagaaaacgaagtttccacaccaaccatgagagtggtgataggaatgaaaaaggccacccgacctccctctgctggcctccccggcagcacgcacctgtctctgcagttgcctcctcttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccagctcatggacctgccggcagagcgggcagccccattctatgaggctcaacttcatgaagacgattgagaaacccaccgtgagcggcacctcaggagatcagggaggtggctttggcctcccacaggatgcatggccgggactcaagatgacccctgagagttcagaccccagccttatcctcggaccccccaactcagacccatcctcgactgccattctcagcccctcccagcccctgcaccagtccaaaaacctccttccatttccgatgatagttcgctatgaaaaaggccaggagctagcctcgcatggactggtgaatagcacagagggtgggcaggcgaaacatggacgagaaaaaccacccagagccacttacgttcttgcccacgtcatccttggagctgaccaggtcttccatttcggctttgagcattttgttggtccgctcgagttcctctttggcttccaaggcctcttcaagggcccgagccagggacagggccttggtttccttctccctggcttctgcctcagctctgtccctctcatccgcgtatttggaagagatgtttttctcctcggctaacaactacaacacaagacccagaggtgacttctaggcatatccggggtcagcgtcactgaattgtaaataccgggggaagccctgtgtcctgctgaatgtattgaggtgcaggtgtaagcagtgtaggttagctatgggagtaatttatataatcatctggcgttctgacttctacatcaaccttatgcagagccagaaatcagctgacttgtttttttttgttggtttgtgtgtttgtttgttttagatggagtctcactttgtcacccaggctggagtgcaatggtgcagtcttggttcactgcaacctccgcctcgtgggttcaagcgattctcctgcctcagcctccagagtagttgggattacaggtgcccaccaccacacctggctaatttttgtattttaagtagagatgtggttttgccatgttgaccaggctggtctcgaactcctgaccctcaagtgagcctcctgcctcggcctcccaaagcacggagattacaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatcttacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggccttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcaggctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcgtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatagaattagtctttataaataaatatgtgggccgggcatagtggctcatacctataatcccagcactttgggaggccaaggcaggcagatcatgtgaggccaggagttggagaccagcctggacaacatggcaaaaccccatctctactaaaaatacaaaaattagccagacatagtggtgtgctcctataatcccggctacatgaaaggctgaagcaggagaatcgcttgaacccagtggtggaggttgcggggagctgagatcacaccactgcactccagcctgggtgacagagctagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacatttagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaaggaagggttttttttctttttttttttttttcctgagacagagttttgcccttttagcccaggctggagtacaatggtgcggtctccgcacactgcaacctctgcctcctgggttcaagctattctcctgcctcagcctcccgagtagatgggactacaggtgcccacgaccacgcctggctaatttttgtatttttagtagagacttttcaccatgttggccagactggtctcaaacccctgacctcaggtgatccacccacctctgtctcccaaagtgctgggattacaggcatgagccaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagcactgcccaccacaccaccgcgccacctcctcacctgcagcttgtggactttgtcattgagctccgcccgggcccgctccccatcgctgcacttggactgcagctcctgcacctgcgcctccagcttcttcttcttatgttccacctcctgcttggcctggcccaggacccgcagctccccggccaggtctgcgttctctttctccagcgtctgcttattcttgtctaggttcgccttggcctggcgaaggaagcagaggggagggataacagggaggctgtggccgggagaacgtttcaggccctgccctttcctccctcagagaggtccaggaaggcacacaacagggggcacacaatcaccagtaagagatttggggtttttttgttgttattttttttttgagatggagtcttaactctgttacccaggctggagtgccgtggcacaatcttggctcactgcaacctccgcctcccaggttcaaactattctcctgcctcagctgcccaagtagctgggattacaggcgcccgccaccatgcccgactaatttttgtatttttagtagagacgaggtttcaccatgttagccaggctgctctcgaactcctgacctcaagtgatccacccatcttggcctccctaagtgctgggattacaggcgtgagctgccgcacccagctgatattttggattctattttcctaaagctcatgggttgcaatctggaatcccacaagcggtatccaacctgctgacatgtcccctttgaccctttcactacttttaaaaaaatgagttgccgacattttaataaatgtcacataaaaatctggattcccagcttctttttcaaaaaactttaatgtttgaaggcatgccatggcagctcatacttgtcatccccagcactttgggaagcaggcagaaggatcgcttaaggccaggagtacaagaccagcctgggcaatgtagtgagacccccatctctactaaaataaaacattagctgggtgtggggggcacacaccagcaatcccagctactcaggaggcggatggcaggcttgcttgagcccaggaattggaggctgcagtgagctatgatcacaccactgcactccagcctgggcaacaaagtgagaccctgtttcagaaataagtagctttgggaggccaaggcaggtggatcacttgaggtgaggagttcgagaccagcctggccaacatggcgaaactgcatctctactaaaaatggaaaaattagccgggcatggtggcgcacgcctgtagtcccagctactggggtggctaaggcacaagtattgcttgaacctgggaggtggaggttgcagtgaaccaagatcatgccactgcattccagcctgggtaacagagtgagactccatctcaatcaatcaatcaataactaacattctatgtggtgactgtggtggtggtagttacacaatacacatttgttaaaattaatggagcagtaaaatggataaattttactacatatgcctcagtaatcctaaacttaaaaacaaaaacaaaaaaccaacaacaacgaaagatctggaaacagagggtcttgctttccttcaaggcaacaatctgccacatctaagtagcggctggctctgcaggtggggcagtcacctttcaccgcccccgtccttcacaggtgtcgtgtgattgacactgctacttctgtcctagttaagggaaacttattttatggaaccagctcctgtaggcatgtgagttgccctacaggaaaaaaaaagtgtgttggggccaggcgcggtggctcaggcctagaatcccagcactttgggaggcctatgcaggcaggtcacttgaggtcaggagtttgagaccagcctggccaacatggtgaaaccccgtctctactaaaaatataaaaattagccgggcatggtggcagtcacctgtaatcccagctgctgaggaggctgaagcaggagaattgcctgaacccaggaggcgggggttgcagtgagccgagatcccgccagtgcactccagcctgggcgacagagtgagactttgtctcaaaaaaaaaagcgtgttgggcaaaagtaggacgcggtgaggggcttctttccaggttgtagagaaggggaaagagaagcgcaagtatcccgagaggacgagacccaccactcagtcttcccatagtccctgggaggtgctggacgttgaccggtcagccctggatgcccgtcctccctccaagacatgactaagagctgccagacctcagatggggacagggagtctcttggtggtaacaaagcagtgaagcggggaccctaggggacatgggctcccagaaaccttagcccagcctaagaccccagaactggggccaaaccgcacgagggcctggggagcccaggtaggagctgatgttaaacgtttcccccacaagcagatggaaccaggtctctacatcagaattcaagttgttagaggcaaaggcctctgtttccctgcacctgagatgggcagaggtttgcacctctacctgctttgtgcgggtcagtaatggacatgccgtctgctggtggtcttaataactgcgtcttcccaaagaggcctggctgggaatgggcttggcttctagctcctgttcacgtctaatgaaccccaagcatggggagggtcagtgattctgtctggggcctcactcttccaaccataattttttttttttttttttgaaactgagtctcactctgttgcccaggctggggtgcagtggcacaatcttggctcactgcaacctttacctcctgggttcaagtgattttcatgtctcagcctcccaagtagctgggattacaggcgaccgccaccacgtccagctaatttttgtatttttagtagagacggggttttgccatgttggccagactggtctcaaactcctgacctcaggtgatctgcctgcctcgggctcccaaagtgctgggattacaggcgtgagccactgcacccagcctaattttatgtatttttagtagagatggggtttcactatgttggtcaggctagtcttgaactcctgacttggtgatccgcctatctcagcctcccaaagtgctgggattataagcatgagccaccgcgcccggcctttgggggcagtttctaatggtttagcactatccctttggtgctgccctcatgagatctggttgtttaaaagtgtctggcagctccccattctctctcttctgcctgctctggtcatgtaaaacatgcctgcctccccgttgccttccaccatgatggtaagtttcctgaggcctccccagaagcagaagctgctatgctttctgtacagcctgcagaaccgtgagccaattaaacctctcttctttagaaattacccaatctcagggtggtgcagtggctcacacctgtcatctcagcactttgggaggccaaggcaggtggatcacctgaggtcaggagttcgagatcagcctggccaacatggcaaaaccccatctctactaaaaaaaaaaaaaaaaaaaaaaattagccgggcatggtggtgtgtgcctgtagtcccagctacttgggaggctgaggcaggagaatcatttgaacccaggaggtggaggttgcagtgagccaagatcacgccactgaactccagcctgagtgacagagtaagactccactgctcaaaaaataaacaaataatccaatcttgggtatttctgtagagcagtgcaacaacggaccaatacactagtgatagaaccaaatgcaaattccccaaaatttttaggcaatgctgcacccacttaatctagcagaaccaaaagcttccactgaaggggatgtggaggagctgcaacgctgagggtaatgtaactcaggctttcaggaaaacaatctggccgaaggtcgcaagctaaaaaacttaccctggggaatgaagcacaggcactaccccaaaggagagaagagcacccaagattcagcattcggtactgctatttaccagctcccactcccatacaccgcaaagagttccaacaacgggagagtgatttgacctagtcattctcaaattatgccggagagagctgttctgccattgaaatcaaataatgacaagtttcctccagtcttttttttttttacaaaagaaaaatcgctatgttgcccaggcgatctgaaagtcctgggctcaagcaatcctccctccttggcctcccaaagtgttaggattacgggaggcatgagccgccatgcctggccttcctccagtctgcagagaaattaaagtggatagaatgatcccagttttaagtttcatttaaatctccccgaaagtgttgttacacctttgcttatccctgaagggcagtatattgataggccccacccatcctataggccttcagtcctgtagaggccagaaagtggggtctaggaccagactgtttgggtgcaaatcatggctctgtcacttaccagcagtgtgaccttgggtaagtctcttcacctctaggcacctaggacctcagtttctttgcttgtaaaatgagtttaatagtacacgtctcacagggtggttgtgaagattaattgacatactgtatgagaagcatttctattcattcttttttttttttctttttttgagatggcggctcactctgtcgcccagactggagtgcagtagcacgatctgagctcactgcaacctcttcctcctgggtccaagtgattgtcctgcctcagcctcccgagtagctaagattacaggcacatgccaccacacccagctaattctttatatttttggtagagatggggtttcaccatgttggccaggctggtctcgaactcctgagctcaagtgatttgcccgccttgcctcccaaattgctgggattacagacatggtgagccaccgtgcccagcctatttttattgtttgattaaggtctcactgtgtcgtccaggctagagtgcagtggcatgacagggctcactgcagcctcaacctcccaggctcaaacgatcctcccacctcagcctcccaaatagctgggaccacaggaatgcactaccaggcctggccaatattttattttattttatttttttgagatggaatcctgctctgttgctcaggctggagtgcaatggcatgatctctgctcactgcaacctctgcctcctgggttcaagtgattctcctgcctcagcctcccgagtagctgggattacaggcatgcaccaccgcgcccggctaattttttgtatttgtagtagagatagggtttcgccatgttggccaggctggtctcgaactcctgacctcaggtgatccacccagtttggcctcccaaagtgctgggattacaggcttgagccaccacgcctggcctacttttttaaaattttagtagaaacaaggtctcactatgttgcccaggctggtctccaactcctgagctcaagcgatcctcccgcctcagcctccccaagtactgggattacaggcgtgagccacctcacccagcctgtatgggaagcattttgtaaataaatataagctgctatcatcatcattagaatcttatgtaacttgttttttgtctttatgcagaccctgacctgtagtaatttgaggctgctgatgtcactcttatgtgtcatcaccaaaaagcatcaccaaaaagcattaccctcttgaactgctcaagctgctctgtgagctcctccaccgcctgtgcgtgtttctgcctcatctcctggacctgagcctcatgggaccgcgtctcttcatccagggccttcttcagcaccgtcacctcctgctccctcttggcccttggtgggaggaacacagtgaatggcagttgggtggagacagagggtcatctcagtgccgtgcaaaagaatgagagctcttccaggacccagagctgcagtcctcatcaccacccctctctagctgtgtgaccttgggtcattcacctaacatctctggacctaaaatttcctcagctgcaaaatgtggagcatatcacctgcctaggacatctgtaatgactggcaaacaaatacacaaagtaatagaattgaaaggatgtctgtgaactgcaaaattttgcttaaatattaatgttggctcttatttaatgagcagttactatatgccaggccctgagctaagttttttatatacatcatctaatcctcagagcaacccaaagaggcaggtgtgttattatttccattttacaaatgaggaaactaaggctaagagagggtaagcagttttacccatggtgtcacagccattgtgtgatggagccagaattagaagctaaaccttgaccttgagtccatggttttgtttgtttgtttttgagatggagtttcactcctgttgcccaggctggagtgcgacagcgcaatcttggccccctgcaacctccacctcccgggttcaagcgattctcctgcctcggcctcctaagtagctgggattacaggtgcccaccaccacgcccggctaattttatatttttagtagagatggggtttcaacatgttggtcaggctggtttcgaactcctgacctcaggtgatccacccgcctcagcctcccaaagtgctgggattacaggtgtgagccaccgcactcagcctggttttttgttttgtttgtttgtttttcttatcgagtcttgctccgtcgtccagactggagtacagtggaatgatgtcagctcactgcaacctctgcctcccaggttcaagggattctcctgcctcagtctcccaagtagctgggattaccgacgcccaccaccacgcccggctaatttttgtctttttagtagagacaggttttcatgatgttggccaggctggtctcgaactcctgacctcaggtgatctgtctgcttcagcctcccaaagtgctgggattacaggcatgagccaccatacctggcccatgcactgggctcttctgtatcaaaggccaagcggcaagggagcagaacgctgtgctctatgtgcatgtgacactgcacaaaacccaaagtgggggaagtaaaccccagggtatatggtgttggcacagctagcatagctatatgctatgatacatgctatgccaacaccacagattgcatcaaaatacatttatgtgtttactgaatgaatcaatgacctagtttcactagagtcaggattcgtgatctggcaggcagtttgttattgtttgttcatttgaagtgaatcttcaattgaaaaccaatctgatcaattttatttttaaaatttaacacaaaagtgatacacacacatacttgggaattggagcttggggactgactgatacacacacagacaggaaggaatttctcaagaatgttaactggtgtgactaagggtgatttttttgttttttgtttttttttgagatggagtctcactcactgtgtcacccaggctggagtgcgatggtgcgatctcagctcactgcaacctctgcctcccagattcaagtgactctactgcctcagcctcctgagtagctgggatttacaggcatgcgccaccacgcccaggtaatttttggatttatagtagagacagggtttcaccatgttggccaggctggtcttgaactcctgacctcaagtgatccacctgtctttggcctcccaaagtgctgagattataggcgtgagcccgaccctaaaggtgatttttttttatgtctgcttttctatagttttcaaattgttctctgagtatatccaagcttaccaatgaggatggttttgaatgcagcctgacacagagtcataaactttcttaaaacagtatgagatgttttttccaatttgtaaaatttttttagttgatcagctattattagtgttagtgtatcttatgtgtggcccaagacaaatctttttcttccaatgtggccaagggaagccaaaagattgtacatccctggtatatactactcttctgatgagaaataagatgatgagggtcgggtgcagtggctcacacatgtaataccagcagtttgggaggcggaagtgggtggatcacttgaggccaggagttcaagtccagcctgggcaacatggcaaaactccatctctactaaaaacaaaaaattagccgggtgtggtggcacatacctgtaatcccagctactcaggaggctgaggcatgagaatcgcttaaatctcagaggtggaggttgcagtgagccaagatggcacaactgcactccagcctaggcaacaaagccagactgcctcaaaaaaaaaaaaaaaagaaagaaaaaaaagaaacagccaaccatgcttctataagttaaagcaaaccgcggccaggaaggtaaatgcacaggggctgatgcacgatttgctttgggtttgtcccctcttctgcccccatcccattggtgcagtgggatagcaggatggtgggattgatgggcccctcacctgagctcctgctgagtggctgtgctgtccagtgtgtcttccagctctgtctttagggcctccagctcctcgccgaggtctcgcttctgcttttcagccttgttcctggcggcccgctctgagtccaggtcctcctggaggtctgagatgtggccctccagctcccggatcttcttcagggcattgttcttctgagcgatttcatcgtcaagccttccagggagagacccagcagaatgaacccccaggtcccttggtttcctctcttacaatgtggccaaaaacttttctgggaccagacagttatgttgcagagacatcaaacaccttctatccatgtccccaggtctgcttcttgacatgccagactatatgagattaacataggatgtgagtgccaaggtctgacatcaaaacaggttgtacatgtgcatgggtgtgtgtacgtgtgtatgcacgtgtgtgcatgtgtgtgcaagaatgcaaagcattgaccccagactggcaaggtacctggtcacagtagggactgtgtagatgctttctgaatgttggacagttcttcttccctggcaactgtctgttctttctgcatttgctcagtgactgagtacccgccccatgcacagcatttggccagccactgcttgcgggggatattcagactggggctctgcatctggtggaggtggtgaccagagatcaaggtgggctgcaagaagccctgttaaatggcagaatgctgcaggagaggcaagcactttgattttactgtacttgtgaaagggcagcaacaagagagaaagtgaaatagttgggttggggtgagactgcagagggtggatgggctctgagggtgaggctaaggaaactggattttccctagtaagccagtgaagttaggtttttgttttgttgttattattgttttgagacagggtcttgctctgttgcccaggctggagtgcagtggcatgatcatagctcactttagcctcaacctcctgggctcaagtgatcctcccatctcagcctcctgagtagctgggactacaggcacacaccaccatgcctggctcattttttaactttttgtagggacagggtcttgctatgttgcccatgttggtctcaaactgctggcctcaagcaatccccccacctcggcttcccaaagtgctgagattacaggcgtgagccactgcatccagccagcaaagttttgtgagcaggttcctgccccagagagatgctttcccttcatcaccgtagcactgtcaacatagcacaaattggccgacaaaagagccaggccaggggatcaatcagaaagctttgaggcttaaatcccagctctgcctcttagaagcaatgacattgctcctgttgcgttacccctaggaggctcagcttcctcctcaaagacaccggcagtacacctggccaggtgtctgcaaaggtattgcttgaaaagaacttagcaccgagtgagcaggtaaataatcattcatagtggctgctgcagtattagcattagtgtaaatccagctaagagccaggaagagggaaaaaccagaggaaatgggtgggggacatttagaaggactggcagaatctgaaggttgctgcttgctgtgggtcggcagaaacaaaggaggagattggtgttcacaaaaaagagggcccttagagggaggggctggggaaaggaaggtcattcccgccttagacaggggtgtttgagatgacggtggaaattgactcattgggcaatcggaaattcagaagggggtctagatgagaaaagcctggatgtcgaagaggcagcagcaacaccatgggagtaggtgagatcaactgcaaagacatgatgtgtttgcagggaagagaagaaagtcgaaggtgaggatctgggggagtgaacagggtcgagaaggcttgtgggaggcctggcctgggaaacgaagttcatgccaagggcctggggccgccttgaccaagacagccactgcgaatgagcgaatgagcaggggcccaggggatacatggacacacagcaaatgccccttgccagccccgctacctggccagggccgcctgcagctcctcctccttcttggccagctgcatcttgagctctgcgatctgcgcctggaggtcagcgatctgctcgtggaagtcgctggcatcaccctccagcttccgtttcagcttctccagctcctgtcggctcttctcttccttctttagccgcactgcaaaaaccaaggtgctcttcaggaaggggaggccccagagagatgcccggaaatgagccttcctgcccaggcattttacccggaggagatgaacacatcccccaatcagtaaccatcatagtcacggtctggaccattatctcccgatgaacagcaccttatattgtcataatattattattagttgagatggagttttgctcttgttgcccaggctggagtgcagtggcgcaatctcagctcactgcaacctccgcctcccgggttcaagcaattctcctgcctcagcctcccgagtagctgggattacaggcgcccgccaccacgcctggctaatttttgtattttgagacagggtttcaccatgttggccaggctggtctccaactcttgacctcgtgatccgcccacctcggcctcccaaagtgctgggattacaggcgagagccaccgcacccagcccttttatcatattattagtgcatgtgatgactaagggtgatttcgagaggtggcatagagttagttgtcactcatgggatgatctgccatcctcaaatttcctttctgattttcctgcttttaaaaatacccattcaagcccaggaatagtggctcatgcctataatcccagcactttgggaggccaaggtgggaggactgcttgggcccaggagtttgagactagactgagcatcatagtgaaaccccatctctacaaaataaaaaataaaaaaaaattagctgggtgtggtgatgcacgcctgtagtctcagctgctcaggaggctgaggcaggaggatcactggagcttaggagtttcgggctgcagtgagccatgatcgcaccactgcactgcagcctgggcaacagagcaagacctcatctctaaaaaaaataataaaataaaataaaaataaatctcttggtagctggtttaccttccagttctgaaatcatagattcatgcttgtttttcagcttggtaagattcttggccttttcttcctcttctgcaagatttgtcgttaagtcactaatcctctcctcaaggagttttcgttcctttttggggaaagagaaagagatagctttaggatttttcttttctctagaatctatgtttcacttttagtgatttccatgtaaacagttgaaagaaaaacccacattataacaaaatacaactagagttttaaatggtaaagagaagtcccataacaatttccaaaaactggccatttctcatctcgtgccagtttgtccctcatattgtatggtcagctaaaggtaccctccttccattcctgccactggccagctcttccctgccccagggcctttgcacagtgggccaaccagctgagatgctcttctactcccctctaactgctccttcatctttaagtttctgcttaaatgtcacctcctccaggaagtcttctatgaatacccttcctctatcccccactgctgtattctttttttttttttgagacagagtctcactctgtcgcccagggtggagtgcagtgttgctatctcagctcactgcaacctctgcctcccacgttcaagtgattctcctgcctcagcctcccgagtagctgggactacaggcgcccgccaacacacccaactaattttttgtatttttagtagagatggggttttaccgtgttggccaggctggtctccaactcctgacctcaggtaatccacttgcctcagcctcccaaagtgctgggattgcaggcatgagccaccgcacccggcctgccgcactcttaaaatatggtgaacgtttccttcagagccctgatcaccatggtaaatgacgattatttgccatctcactacagtataaaccccacaagggaagggtcctccttcaccatgcatacctgcatctaacacagagcctggctcacagtaggggccaagctgacatccagctcaaagaactaaaagcaggtggggctggttagtgactactgactacggtgaccagcttgtcctggttttctaagggcttttctgctttgagaactgaaagtcccaaatccccaaaatctccctgatcctggtaagcctgttgtttttaatgcagaaacttgattccacttttttttttttttgaaacagagtcactctgtcacccaggctgcagtgcagtggcacgatctcagctcactgcaacctctacctcccaggttcaagtgattctcctgcctcagcctcccaagtggctgggattacagacactggccaccacacctggctaatctttgtatttttagtagagatggagttttaccctgttggccaggctagtctcaaactcctggcctcaagtgatccacataccttggcctcccaaagtgctcggattataggcgtgagccactgcacccggcccctactcacttttgatagtttattgttctgatcatccatgaccaggatctcatcctccagtttcttgatcttggcctcagccgtgaccttctcaagttgcagcttctgcctggcagcttcctcctcctccagctgttcttcaaggtcctttgttgtggagggaaaagagtaacagctttggttataacagatttactctcgtggtgatctggggactaatgaatacaggggctaggcctgaagatgcccagaactctgtagcctcctaaaaggaagaaataaaggcctgagcgtggtggctcacacctgtaatcccagcacttttggaggccgaggtgggtggatcacttgaggtcaggaattcaagaccagcctggccaacatggtgaaaccccgtctctactaaaaatacaaaaaaaattagccaggcatggtggtgggctcctgtaatcccagctactcgggaggctgaggcaggagaatcgcttgaacccgagaggcagaggttgcagtgagctgagatcgcaccatcgcaccccagcctaggcaagagagtgagactctgtctcaaaaaaaaaaaaaaaataaagacctgggtaagctgctctgcttcatggaacctcaacctcctcatctataaaatgagcacagtaggtaccatggtggttttaaaatctatccacaagttctttgcgactccaaaaaggtggagcctaattctcctccccttgagtgggggttagatttgcttctaacaacaacaacaaaaatcaggaagaagtgatggaatgtaacttcagagattaggctataaaaggcattgcggcttcctttctcctctctcagatcactccttctgggggaactctgctgccatattggaaggacactcaagcagccctgaggggagaggccttcatgataaggaactgaggcctcctccaacagctgtgtgaataagccaagtagaagtgggtcctccagccccagatgagccttcagatgactgcagcctcagccaacaccttgactgcaacctcaggccggaccctcagccagaaccactcacctaagccactctcaaattcctgactatgcaatactttttatttttagctgctgagtttggcatgttttgttatgtagcaatagctaacaaatacaattatcctccattcaggcttgctgttaggagaaaaggggttagcacatgcaaggcagggcaatagaacagagtgggctcactgtgttccagtcccaatcccagctgtgtggccttgatcagatgaccaaccctctccaagcccccgtctcatcatctgtcccagcagggacacatatccctggatgcacctccacaggcctgtggtgagggtcaagtgatttgctacccaccacgggctgcccctgtgacaccttaccagcatctgctgggccatcttcttcctttcagcctgtagctgctggcccctgtcttcctcctcctccaggcgggcctccatctcatgcagtatctcctccagctcctgcttcttggccgccagccgcacccgcatctcctcagcctctgcatacagctctgtctctgcctgcagctgttcctgtagcaggttcttctcctcggtcagctgcacgcaggtggtggggaggaggcgggtgagccccacggggccaagtcctgttccccagcaaccccagccatgcatccatacaggtacctgcgagtgcttctgttccagctccttaagctcattctctgccttctgctgccgctccttggtcttctgcagttcatcctccttggcctgcatctcctcctcctgccgtgtcacctgcagcagtggcttcacctgcacacacacggttagcccatcatttgtttttgtggcaaagggatatgttgtcataataaattcgatcagtggttccgagccagggacaatgttgcccccaccgatccccactaggggatattgtctggagacactgctgattgtcacagctggggtggggggtgcctctggcatccagtgggtagaggccagggatactgctaaacaccctacagtgcacaggacagcccccacaacagaattagtcaccccaaaatatcaacagtggcaagactgaggagctctaaatcagagcaccagaaaaggtacaaagtgaaaggaaaaagtctcatcttccccactttagaaccatcccaacagagaactactgctgaaaagtgatatttccttccaaggacaaaagggagaaaaaaaatctttcatatcccacccacctccctatcaaagtcattattaacattgtttacatttccttcctggctctttttctatgtttaaaaaatagacttaagaccatgctgcctagttgtagaggctgcttttattatttaaaattatatgatacagacaggaacagtgatgcatgcctgtaatcccagcattttgggaggccgaggcaagcgcttgagcccaggagtttgggaccagcctgggcaacatcatgagaccccatctctacaaaaacaagtaaccaggcatggtggtgtgtgcctgtagtcccagctagtgaggggtctgaggcaggaagatcgcttgaaccctgcaggctgaggctgcagtgagccacgattgtgccactgcactccagcctgggtgacacagtgagaccctgtctccacaaataaaatttttttaaaaattataagatatgtattaccccatgctgttacatcattcttacaactttacatagccatcttttaagttaatttatttatttagcgatggtcttgttttgtcacccaggctggagtgcagtgacacaatcatagctcactgcagccttgaactcctggcctcaagcgatcctcccaccccagctccagagtagctgggactacaggcacatgccacagtgtccaactagacagctaggtagaagtcttttttttttttttttttagcagacctattcagtagccaaagccatcattttaatagctgaaaacattccattgatagatgaaccattattgaactcatcattcagctaggactggacactgaaattctgctattgtaaataaggccataatgaatgcccttaactcttgattttcttttctctttttcaggtggagtctcgccctgtcacccaggctggagtgcagtggcacgatctcagctcactgaaacctctgcctcctcggttcaagtgattctcctgcctcaatctcctgagtagctgggattacaggtgcccaccaccacacctggctaatttttgtattttcagtagagatagggtttcgccatgttggccaggctggtttcgaactcgtgaacccaggtgatcctcctgccttggccacccaaagtgctgggattacaggcatgagccaccacacctggctaagacgattttcttaggatagtttttcagaagttggttcagtggggacgaacatttccaaaaagcagcatctgctgtccttccctgggctgcctcctaactctttgttttcaagcccctgcctggcacaaggaagcccctgctatgtactccagcagcttgcttcatgcacttatcacagtttgccattatgtatctgtctctgtgattatctgtttattgtttactccccaccaattcggctagaatattcatggaggtcagggaccatggtgtgtgttcacagctgcacccccagcacctagcatgtgcctgggatacagcaggcactcaatgtctgtttgcttggtgaaaaagccttgcaccagtggatacactcaagggcatataaggagaagcctagtctattgcaacagagcatgtctttgtgccatggggacaatgcaaccagtgccactacaggaaccagttgagtcctctggaggccctgactctgccagaaataaaaaataatatgctatggccagatgaggtggctcatgcctgtaatcccagcactttgggagcctgaagcaggagggttgcttgaggtcaggagttcaagaccagcctgggtaacagagtgagactccatttcaaaaaatgcaaaaagtaaaaaaaaaaaaacctgcagtattgatacatgcaacagtctggatgctctctaattccatgtatagaatatttgttttatttttttttgagacggagtctcgctctgtcaccaggctggagtgcagtacagtggcgcgatctcagctctctgcaacctctgcctcccaggttcaagtgattctcttgcctcagcctcctgagtagctgtgactacaggcgtttgccaccacgcccagctaatttttgtacatttagtagagacagggtttcaccatcttggccaggatggtcttgatttcttgactttgtgatccacccgcctcggcctcccaaagtgctgggattacagccgtgagccaccgtgcctggccttttttttaaataaaaaaaaaaagaaagaagagacagagtctcaatctttcacccaggctggagtgcaggcatgatcttggctcactgcaacctctgtctcctgagttcaagagattctcctgccttagcctcctgagtatctgggattacaggtgcctgccaccatacccagctaatttttgtattttaagtagagacagggttttgccatgttggccaggctggttttgaactcctgaccgcaagtgatccgcctgcctcggcctcccaaagtgctgggattacaggcgtgagccgccgcccccggcagcattcttgaaccatcaaaattacagaactggagaacagagtggtttccatggctacggaggaagtgggtgtggctataaatgggccacacgagggattccagtgcggatggaaatattaatactttgtgttaaggtcctggctatagcctatgtgccaaaggacagggcctcctcgggccagagaaccgccaatgctcaaggtctgagttcgagccctccattccacacccacttgcgaccacctcctgtcccaaatgtgaaggctccagagtgaagaagcagggctgggggcccctgggaagggggctggggcagagcactcactttggtgaaaagcctccaccactgccagttccgcagcttgaggtaggcggcgcagttcctctgaatcaccttcatggcggtcagctgctgctgcctcttggcaaaagccctagggaggggggaagagaaggtgcgggggtcatgaagccacaccctgctgtcaacagagccctgccctgcagcatcctgaacctgcacagggacatgccccaatctccccaactcaggttcttccagaaaccctgtgtgacacatgtgttgtctggctgcaaacaacttaaatcatctacaggacagagcctttttcagtggacaaggaagacccagggctcacaacatgccctggacttagctgagatccaaacaccactcagaaaacacaactatgtgcatcattcctaagggggctcccgtactccccagctgcactagctgtttcttttttctttctttcttttttttttttttttttttttgagatagagtttcgctcttgttgcccaggctggagtgcggtggcacgatctcagctcactgcaaactccacctccggggttcaagtgattctcctgcttcagcctcctgagtagcttggattacaggtgcccacaaccatgcctggctaatttttgtatttttagtagagatggggtttcccatgttggccaggtgggtctcaaactcctgacctcaggtgatccacccaccttggcctcccaaagtgctgggattacaggtaggagccaccatgcccagcctacaccagctgtttctgactaacttatttatttatttgtttattttcagagacagggtctggctctgcggcccaggctggagtgcagtggtgtgatgatggctcactgcagcctcaaattcctgggcttaaatgatcctcctgcctcagcctcccaagtagttgggactacgggcacatgctaccatgcccagctaatttttaaagttttttttttttggtagagataggggtctcgccatgttgcccaggctggtctcaaactcctgggctcaagcaatcctcctgcctcggcctcccaaagtgcctgggattacaggtgtcagctaccacacccagccctgtcaaacctattctctcctgggttgttttaggaatttcacactgtgaccctgaaccagcactcttcccgtttaagggctatcgatagattgagaaacgatagaacagtgaacgtaattctgtcttccctgcttggctgccatcttggacacaggaaaactttaagaataaaattgccccagttatccaggaaggacagcaacagggaacttagtaacgaaacttgacaagttaggtctgttgcgggagggccaagagctcccaaagctggccttgaccatcttgggtccatgtgtcaatgaatgaacctgacacatcagggtcctactggtgagggtgtggtctctgcccaatgacaacacacaccccagacagagagcgaccccacctgtccctgcagtccctggggtatgactttcattaaggaacccgaacccttccccggctcccagtcttcacagaacagctgggacatcacaccctccaaaaccctgccttataaatcccactgggacacggggatctagacaccgtcaagtcctctttcctcaatggtttatccaattctaacatgtctaggctgggcgcagtgggtcatgcctataatcccagcactttgggaggccaaggcaggtggatcacttgagaccaggaatttgagaccagcctggccaacatggtgaaactttgtctctactaaaaatacaaaaattaggccagtgtggtggtgggcgcctctaattccagccactcgggaggctcagacacgagaattgcttgagtccaagaggcagaggttgcagtgagttgagactgcgccactgcactccagcctgggcgacagagagagagagagagactctgtctcaaaaaggaagaagaaaggaaggaaggaagggagggagggaaggaaggagtgagggagggaggtaaaaacaacaacaatcatttctgacctgagaaccacgcactgttctaagctctcgtcatgcgttatcttagtgacacctcatgaacagctctctgaggtcaaaatgattatgctcagtttccagctaaaaaactggaagctcagagaggtagagtaacttgcccaaggttcatcagcaaaaactggggcatccacgatgagaacccaggtctaaaactcgttcccttcctgcactcgtaacttggtacatttatttaaagtagaagcatttcttccccttcaagaaaaggctgtcattcagtcaatgatgcatcttaaacaggtggcctcttagaatcagggaatcagaacagaaaggcccctgtttgtgattcgcgtttgaggtattaggatgcaggaaagcatctttactttctggccaagtagccacgacacatcgcctggaaggccatgatgacatcggtgatcttcaaatctcgctcctcctctaggtgggccaggacgccagttcggaagaagattttgctctgccctatcctgtataagttggggtcaagttccagggctttgatctgcaaaaggaaggaaaggaagagctcctgatttccactgtgccatttggccagtgatgacatgggtaagaacggtcccaccaagagcagcaggtggcttgcggccagaggttgggaggtctctggtggacttctgggctcaccatgagaatgcaggcctgcttcccgtccatgaagcctttggggatggcattcgccgccaggatctcgtagcttgaaacacagagcagaagtcaccccgggtacctccagcatccattcctccacccagtcccgctcaccccctgccctacctgggccagaccttgggacttaccgttggcggaactcctggaagacgatccggttggggaagccctgccggcagatgcgaatgccttccagcaccccattgcaccgcagctgctccagcaccaggaacgcatccagcttgccggactgcaaaggtcaaagagggcagtggatccctggggccagaaaccatggcgcagcaaagccccaaacctcctacctggatgacccacctggccaggccatgagggtaccaacagaagcacccaaggagggcttagctgagggccgaggggcaaagcagtgcccccctctgggttttcatctctttgcttcggcaatggctgcctcatgatctctctggttcttggtgacactagcatcgcctggctggaacctggggcttcctcctcatcacctcgtctccctcacttcctgtccatcagcagtttgattgcttctagctcccaaatatctcccaacccccccacttctcttcaccaccattgtctccactatcttctcctgcctggacaaccacagaaaccacccacctggtctctctctctggtcttgcctctcccctcaatccctttgtcctttttattttttgagatagggtcccattctgtcagccaggctggagtccagtggtgcgatcatggctcactgcagcctcaaactcctgggctcaagtgatcctcccaaatcagcctcccaagtatttgggaccacaggtatgtgctaccatgcctggaaaatttttaaaaatgtttttgtagatatagggtcttgctatgttgcccaggctagccttgaacacctggtctcaagtgatcctcccacctcaacctcccaaagtgttgggattataggcatgagctagcatatgcccagccccctcattcacttcctaaaatgtaaatctgaccatgatatagccctgctttaacacccccaatggcatgcctagagagagaaggccaagctccagaaagaacacaaggagcaccacgatctagcccctgcctacccattcagcctcaatcctacctcacaccatctgattcctacctcatgccatcacacatttgcaacatgaaatgacctatttagcattttctttccttttttttttttttttttaagatggagtctcgctctgctgcccaggctggaatgctgtggtgcaatctcagctcactgcaacctccgcctcctgggttcaacagatttttgtttctcagcctcctgagtagctgggattacaggcgtgagcaacacgcctggacactatctagcattttcttacctagttccttcacttctcacctccacactcttgcttagcctgggccctctgcttatcctaggccccctgcttatcctaggccccaccctgccttccatgtcaccaagttgatggccacacattcttaacgttcaagttcaccagaagctttctctgagtcctgaggctgtgggaggagccctggctctttggtgttctcctaactgaccacattccatcaccatcatcagctgtatgtttacctctccccgtgtctcccataacctcagcactactggcatcttgtagggattctgtgctgggggttgagggaccatcctgtgcattgtacaatgcttagggcatccctggcccctacccactagatgctgactaacagccccctcctggttgtgacaaccaaaaatgtctgtagcatgtccatatagaggacacaatcgccccaagctgaagatgcctgcaccagattatgagaaacccacagggaagggctacaatttttctaacactgctccccagcacccaggacagggcagagcccagtgaatacttcctgggataatgaatgaatgagtggctggatgacctgcacagcaactccacaactgaaaagtctctggatgcatcctcccttcctccttttcctccagggatggggaatgggtctgagattcagatagccttccccacatggaaaatggggtcctcggggtaggtgggggcagagggcgccctggggacgctgtgaccgcttgggacagccctggcttctgggagccccagggtctgggcggcgggcctcaccctcttctcgtggttggggatgatgcagcgcacgaagttgggcgtggtgttgcgtagcgtggtcatcagcttgcccagctgctccttgtacagctgccccactgtgcggaacatgcccttcttggtcttggaggcgctgggcagcgagctctccgtcatcttggccatctggtccaggcccacgatgcggtccactatggggcacagccagggtggcatcagcctctggcccacccacccctaaataggccagaggctcagccccagccccacccaccaacctgcccactccaatctttccttccatcaccaacgcctccttcggcagtcagggtttccaagtattgtctattggggaaatcctgagagcacctgagtggcagaaagaacaaattccctgtgatggagtcacgctgacctaggagtcaagcctgctctcgctgtccactcactgactagccttggcttggcactatcctgtgcctcagtctccctttctacaaaagggaggtaataataccgtctaccttctagggcaggggtaaaaaaaaataaggcacagaaggcacttattccctgccagcctccaatctttcatccaccaacaaatagttattgaggaccttctgtgctccaggccctggggacactgctgtgaacaaaaaaagacccggccccctcaccccgcttatatcacagggaaggagacagacagagatcacagatgttaagtatggaatatcttgagtagtgaggtgtgcgtagaaaaataaaaatagggtaaagcggagagagagtgaagagggtgctctcttagacaaggaggtggtgggctctgctaagttgatatttgagcagaaaccagcaagaaatgagtgggtaaccatgtaggtatccacggaagaaatattctgaggcagaagatacagcacacactccgagatagcctggcacatcagtaagtgctcaacaaaaagtaggtattattattattattattattattattattattattattatcattattttattttattgagacggagtttcactcttgttggccaggctggagtgcaatggcgtgatctcggctcaccacaacgtccgcctcccgggttccagcaattctcccgcctcagcctcccagtagctgggattacaggcatgcgccaccacgcccggctcattttttttatatttttagtagagacagagtttctccatgttggtcaggctggtctcgaactcctgacctcaggtgattcccctgccttggcctcccaatgtgctgggattacaggcgtgagctaccgcgcccggccatcatcatcatcatcatcatcatcatcatcatcacctccaaggttctttttctaccagcccagcaggtcctgcacatgccaagcccaacccacaggccatggatggcaccatttcttcaccttctactcagattctgtgtaacaatcttttttttttttttttttttttgagacaagctctcactctgtcgcccagctggagagcagtggcacgatcttggctcactgcaaccttcaccacccaggttcaggtgattctcctgccttagcctcctgagtagctgggattacaggcacccaccagcacacccggctaattttgtttttattttttatttttagttttattttttcaagacagagtcttgctcttttgcccaggctggagtccaatggcacaatctcagctcactgcaacctgcgcctcccaggttcaagcagttctcctgcctcagcctcccgagtagctgggattaccaccaccacgcccagttagtttttgtatttttagtagagatggggtttcgccacgttggccagactggtctcgaactcttgacctcaactgatcctcctgcctcagcctcccaaagtgctgagattacaggtgtgagccaccatgcgcagcctcatgcttgtctctctgcttgtctttgagagtctcatctctcccacaagactgtgggtcccgcagaggagggactacaggcttcatcatgtgtcctgggatgacacagacccagggtgcgatgttgttccctaggcccagagcctggcatatggttagggcacagctggcccctcctggagccctttttttagcatgcttaaaacaaggggagaccagtcctgtaagccccaggcccatgggccctgtgccaagaataaaacctgctgtggacactgatggccagggacaaacagcaaaccccctcccctcatcatcactccagcagctcttcacagggatcatctattcactggttctcaaagggagccggagtgtggtccctagaccagcagcatcacctgggatgaatgttttcaggcccgccccatccctggccccagacctgcagaattagatcttagggtaggcccagccatctgggttttaaaaagccctccaaagagggccaggtgcagtggctcacacctgtaatcccagcactttttgaggctgaggtgggcggatcacctgaggtcaggagtttgagaccagcctggccaacatgggggaaccccgtctctactaaaaatacaaaaattagccaggtatggtggtgtgtgcctgtaatgctagctacttgggaggctgaggcaggaaaatcactggaacccagaaggtggaggctgcagtgagccaagattgcaccaccgccctccagcctgggtgacaaagcaagactctgtccctaaataaataaacaaagccttccagggggtcatgatgcctgcttgagtttgagcatcactggtctaatttaaccctcataatacctctagtagagacggcaactattattgcatctcctgttttactaatgaggacaatgaagcttaatgacatcaagtgactcatccaagaccacagagctaggaggtggcagagacaagatacagtgaagtccttctgactctggacagggcagtctaactccccgtgcctggcatgctgtttctcctctattgcctgagccctgacctcaggacctcaatcccctcgggacatgtaggattgaggggctcagggacccccactcaggaagaaattgtttcaacgagacatcaccagcccatgccaatgctcttccttcccctgcccccatgtaaaggcctcccctcctggggcaggtgtgagagtcgggggacttgggtgttcaattctccagctcaaagcagaacatggacccgagcagagaaggccttaccgtccttccacaggtcggccacaaacttgtcggaggaggcattgagcagggaagtcacgttgtcattcagcgggtccatattcttggtcagccaggcactcgcattatagtccacctgccaaggacaccctgctggtcagaacccctgggaaactagaaacttagaaaccaaggccaggaccccagccctcccattgtccttccagatcttctgaggtcagagaggaaatgacgtttatgaccaccatgatgggactccacaaacaccagtgaagagaccaacagcccagggacctgtgcccacgtagtaggacatcagccagtgatagccattgctgggaaagcctagtttccattccatattctcctactaacgctgctgtggtagcctccctcctcctaagccagcacagtacctgtgagttatacactattaagagatttcatgacggcagatgccctcctgccgacatgcaaaactcccccctcatcatcttcccaatcatcctggtttagaaattaagcatggcagccaagcgtggtggttcacactggtaatcccagcactgtggaaggccaaggtgggtggatcatttgaggtcaggcgttcaagaccaacctgaccaacatggtgaaaccccatgtctactaaaaatacaaaaaaaaaaaaaaaattagccaggcatggtggtgcacacctgtaatgccagctactcgggaggctgaggcaggagaatcgcttcagcctgggaggcggagattgcagtgagctgagattgcgccactgaactccagcctgggtgacagagtgagactctgtctcaaaataattaaataaataaattaattaagcatggcatcctattttccactctctaatgagcataatttgtaactcagagatcctgatatatggatatacagaaaaaggacatataggctttttacattcctgactcaaacaatgacaatgcccaaagccgtaatttttactatggtgaatattaaatgaaaggaactgataatacagctttgctgggttatcatgggatgtgggttatcaggataataggtaggcttgatctgagagaagactgaaaataataataaaaaaaatccactgatgaagtagggaaaagaaaagtgttgtctctatatgcttaaaggaacatatacccccttgaatataggctaggagttgggaaacttttggtgaaggcccagatagtagatatttttggcttggcaagtcatacaatgttttgtttgtttgtttgttttggtttttgagacagagtggttctctgttgcccagtctggagtgcagtggtgcagtctcagctcactgcaacctccaacttcctgggtcaagcagttctcttgcctcagcctcctgagtagctgaggttacagttgtgtgcctgtaatctcacagctggctaatttttaaattttttttattttttatttttagcagagacgggctttcgccatgttggccaggctggtctcaaactgctgacctcaagtaatccacctgccttggtgctggggttacaggcgtgagccaccacacccagccaagtcatacagtctttgtcgcagctactcaactctagcactgtagtatacaaaagcagccagccatagacattatgcatacaaatgggcatggctgtgttccaataaaactttatttacaataacaagctgtgggccagatcggactctgttgccaggccctggtagagagcattgtttgtgcccatgatgcagtggaggtactgaggagtcaatagaatactacaattctgcaagccagactaagctatgtcctttgtacattatccaggactcttgagagccacagggcaagggcctatacaataacagccaaggcatgttgatgatgatgatgatgatgatgaatacaactatcatagatttccctggccagagcaggctggcaatagcaaactcaagaccgtgacatgggagatttttgttgaagccaggtgtggatgtattagtcaccccattccagttggccccgcctgttgggtataacttgtagcaggaaggatttagagtctatacaagaaaagcaggctgaggccaggtacagtggctcgtgctcataatcccagcacttcaggaagccgaggcagggagatctcttgagcccaggaattcaagaccagcctgggcaacacagcaagaccccatatctatacataatttaaaaatttagctgggcggccaggcacggtggctcatgcctgtaatcctagcaccttgggaggccgaggcgggtggatcacctgaggtcaggagtttgagaccagcctggccaacatggcgaaacccttctctactaaaaatacaaaaattagctgggtgtggtggcaggtgcctgtaatcccagctatttgggaggctgaggcaggagaatctcttgaacccggagggagaggttgcagttagcagagatcacgccattgcactccagcctggatgacaagagcaaaattccatctcaaaaaggaaaaaagattttagctgggcatggtggtgtacacctgtagtcccagctacttgggaagctgaggcaggaggatcgtgtgagcccaggaggttgaggctgtagtgagctatgatcgcaccactgcactccagcctgggcgacaaagcgagaccctgtctccaacaaaaacagaaagaaataactgtctggacgtcacggttggaaaacatgagagtggctacagctgatgccttacagatgcgtagacaaattacgaataggacttggttgggattcgcttagcagcagatggctttgcagtttccaggcagcccaaggttctgccactctcagactgtctctgcgctgagcagccactgggggtcccctgagacagagtcccctgggccctgtggctggtaccttcccagcataatggatgatggagaactcagtcttgtccttgagctgcttgggcttctggaacttggggtggctgccctgctccgtgcacagcttctccacgaaagacttgtccgtggctttggggaaccagcattcctcgtccagcagggccagcacacctggagggttgttctgtgggagacaagtagggcttgaatcagagagaacacccaacctcaggcattccatgaagagctggccaactatacacaacgcatgggcatccgccgagatctgatactgtatttgcccacatataaagatgagtttatgacccccatgcttccaaatctaccttcaaattaccctgtgcccaatggaccagtaacagggatggaaggcagaacataatgtttgctgccgccccctagtgggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccattctcctgcctcagcctcccgagtagctgggactacaggcgcctgccacggcgcccggctgattttttctatttttagtagaggcggggtttcaccgtgttagccaggatggtctccatctcctgacctcgtgatccgcccgcctcggcctcccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctggaatgcagtggcgcaatctcggcttacagcaacctctgcctccagggctcaagcaatcctcccacctcagcctcccaaatagctgggaccacaggcgtgcaccaccaggcccggctaattagtagaaaccctgtctctactgaaaatacaaaagttaggtgggcgtggtggtgcacgcctgtagtctcagccacttgggaggctgaggcgggaggatcacttgaggcagggaggtggaggttgcagtgaggcaagattgtgccactgcactccagcctgggcaacagagtcagaccatgtcataaaaaaaaaaaaaaaaaaaaaaaaagcaatggcagagaaggaaagggaagggaaagagggtagggaagaaaaaaaggaagaaaaaagaggatggaaggaaggcagaaattaaagaaaatacctttgatatgaaaatgtgggttaatggaaattgtaagagttcacaaggattcagcttacagcctttcaggactgggtgatggattgggtgggggaatgctatgtgcatggggagagtgtggggtccacgtcggctccacagaggccacacacgtgtacaaggtgtgacggagccccgcacgcccacgtgcccctcaccggtcgctcgatgagctcgatgcagggctgtaggtccagcccaaagtcgatgaagttccactcgatgccctcgcgctggtactcctcctgctccaggatgaacatggtgtggttgaagagctgctgcagcttctcgttggtgtagttgatgcacagctgctcgaaggagttcacctgagcacatggcgtgggggcggggcgtgagcatcttggtatgaagtcagaagacaaggagccccacagaagctccacccgacagcgcccccatggcccgcccacatcctgttctgccatcccagcacccagacagggctgaggccccaaaacatgctgcctagagtccaccagggctggtgaagttgatatcacatggccctcacacaccttaaagatgcttatctcctccatctgcacaaccatctatggatggacaaacctcgtaaggcacgctactgcatgtacagatgtggaaacattttacagatgtgaaaacagaggcgcagagagaaagtgactcggtagtacacttctttcgggacatctatcaatcttaaaacctcctggctgggtgtagtgctcatgattgtaatcccagcacttagggaggccaaggcgggaggatcacttgaggtcaggagtttgcgaccagcctggcaagcatagcgaaacctctctccactaaaaatacaaaaattggccaagcacagtggctcatacctgtaatcccagcactttgggaggccgaggctggtggatcatttgagatcaggagtttgagactagcctggccaacagggtgaaactctgtctctaccaaaaaaaaaaaaaaaagtagccaggcatggtggcactaatcccagctactcgagaggctgaggcaggagaatcacttgaacctgggaggcggaggttgcggtgagccaagattgcactactgcactccggcctgggcaacagagcgagactctgtctaaaaaaaaaaaaaaaattagctgggcacagtggtacactcctgtagtcccagctactcaggaggctgagacaagagaattgcttgaacccaggaggcggaggcagcagtgagacaaaattgtgacactgcattccagtctgggcgacagagcaagactctgtctcaaaaaaaaaaaaacaagacaagacaaaaaaaaaaccttccctttctctgagaactttcttcaaacccatgggtaaaggatccaatatccatgtttctactacatgaggtattgcaagctcctgcaaacagttcttggcttggaggtgaccatgtagcccaattcaggtgagtaagagtcagtgagacttaattccaagattttggttggaactgttagaaaagagatatgtgctttttttttttttttttttttaccaggattactgagaggcagtctggagctgtggcagccatcttgcccccgtgaggggagagcctgcttgagaatggagccaatatggaggaaggcagagagagagagagaacgatggcgggagatcagaccctgcctacgggatccagctacatgtctggccttctcagttccagaaaccaatgcatttcctgttggatttctgtctcttataccctcaatgatccacccttaactagacagcctcctaccctacagtagccatctacatgcctttctccaaaatcatgactcctccaagaaaaagcccatctcagacaaccaagaccatggctcttaggatcccaccgagctgtacctcaaagatctcaaatccagctatatccaggatccccaggaaggaagccccttgccgatgggtcttgtccagggctttgttcacgcgggtgagtatccagcggaaaaggcgctcatatgttgccttggccaaagcctctacagcaaagtcagcctgcagagggcaaccaggggaacccggttattctcaatgggctccattttcacataagccaggctggtggtgaagatttttattcttggccgggtgcagtgactcacactgtaatcccagcactttgggaggccgaggcaggtgggtcacttgaggtcgggagttcaagaccagcctgaccaacaaggcaaaaacccttctctactaaaaatacaaaaattagccaggcgttgtggtgcatgcctgtagtcccagctgcttgggggactgaggcaggagaatcgtttgaatctgggaggcagaggctacagtgagctgcgatggcaccactgcacccccccctgggcaacagagcaaggctctggctcaaaaacaaaaaacaaacaaacaaacaaaacctgacatgggactgtgaatattctagtattgaataaatgagggataaagagatggatgggtggatgcatggacagatgaatgaatgaatgaatgaatggaatgacagctggatgggtgatggatggacggacagatggacagatggctgggtcatggatggatggacagatggatgagtgagggatggagagatgatgggtgagcagatagatgggcagatgaatggatggatggatggatggatgaacagacagatgaatgagtgggtagaaagatggatggatggacagatgcagaggcagaccatgggtgaatggattaatgaatacatgaatgagtgaacaggtggatagatggatgaatggatggatgggtgggtgcatggatggataagtgataagtacatcattacctgttcttttgtctgagctttctgtaccacatctcgcccaaccttgatacgaggagtgaggatggatctggtgaaatctgtcacattaattcccatgaggtggcaaactttctgagcagctggatggagaaaagaaacatcgtgagtgcatcacaaaagaaatagcttggcaagaagacacatcgcatgggatatttgtgatctgtgaatacagcgggttctcttggggaaatgggacccgctgaccatgaatatagcttgaagtgtcctaaaggctgctgtcattagtggtcacactccccagtattttgctgagaggcaatgattggggtgggctgaagcaggccccagttgggggtttagggtcaggtagttctagtttcaagtccctgtcccttcacacttccaagtcatgtgactttggaaaagctctttaccctcccagcatcttgcttttctcagctttaaaaagggtcagctcttcggtaccttgttggtacccaggactaaataaggtaaagtatgtaaagtccctgagatagatagatttatttatttatttatttgtttatttatttatttatttttggagacagagtctcgctctgtcgcccaggctggagtgcagtggcgcgatctcagctcactgcaacctccgccttccgggttcaagcaattctcctgcctcagcctcccgagtagctggcattataggtgcctgccaccacacccagctaatttcttttgtattttagttgagatggagttacaccgtgttgcccaggctggtctcgaagtcctgaactcaggcaatccgcccacctcggcctccctaagtgctgggattacaggcgtgagccactggcccttgagatttatttaacagttacttagtaagtattaaatagttattaatagtaacatttattgaacagttactgttcaataaatatttctttcacccttctaggatatgtgttgcagcattgtttgcaatagcaaaatgctagagtcaacctaaatgctcttcttttattttgagatgcagtcttcctgtcgcccgggctgaagtgcagtggtgtgaccacgagctggtcccttaacatgaaaatagcattacatgctgctttgcatgtgcaaggcagagtaaatagagtgattttaggatttttttttccccatctcttggcaagagcactttttcatttctctttccctgaggtctttccttggcatccggattccattaatttgccagatttagggactctaatacataacaaacacctgagaatgaaactgccactgcaaaattataactgagacactgaacaagatctgacctaacggactccaccttgcttctaacctccaagctccactgaaccatttgtgggtgtaagccgaattaacttggcaggaacttagtttatagtttattttttatgttttggacacagagtctcactctgttacccaggctggagtgcagtggcacaatctcggcgcactgcaatctccgcctcctgcgttcaagcagttctcctgcctcagcctcctgagtagctgggattacaggcgcctgccactacgcctggctaatttttgtatttttagtagagatggggtttcaccatgttggcgaggctggtcttgaactcctgacttcaagtgatccacctgcctgggcctcccaaaatcctaggattacaggcatgagccaccacgcctagcctcttagtttatagtttaaaacacaagaaccctttcccaaaacaaacccccttcttgcctggagactagactgcctttgtaggaataacaaattagcccaaaggtttgaaattatggtttaggagtcctgtaactggaggctacaagagtctgaccctccctaaattgctcctggggataacatcactattgtaaaacctaagaccagtacttgagatatttttgcggaccctggcaccaggtggatcagctgacaccacccagatcgagaaactggctcatctgatcttatggcctctgtccaggaactgactcagggcaagaggacagcttcgactccctgtaatttcatctctgacccaaccaatcagcacccccaactcactggcctccccctaaccacattatgcttaaaaactctgatccacgaatgctcaaggagattgatttgagtaataataaaactctgttctcccatgcagccggctctgcgtgagttactcttactctatcgcaattcccctgtcttgattaattggctctgtctaggctgtgggcaaggtaaacccagtaagcggttgcaacaggtttgatcaaggtgggctctagggagcgggaaaaagcaacacaatatacagcctgggctgggaaataagaaacctaagttttgctctcagctcagccaccaacaagcatagtggtagccaggccagcttctcaaaacacaaaatactgtttatttgtgggtaggtttatcagatttagggggaaaattacaggatgctcagttaaacctgaatttcagataaacaagaatactcttttggtataatcacggtccaaatgttacaagggacataattaaaatttaaaaaaaggtttgttgtttacctaaaattgaaatttatctggacatcctgtattttatctggcacccctaattctcagggcaattgaggtctgtctccccaagacgaccacagataccgtaagaagagctattcttgtgtcatttcctgctgtatcccagtggcatattgcaggggcttgagaaatatttctttaacaaaacaattaagtggggtattttagaagagatggtccctcgggatcttgtctggtcactattaggggtaggacgtgatgactcttgcctgtaatcccagcattttgggaggccaaggtgggaggatcacttgagctcaggagttcaagatcagcttgggcaacacagcgagacctcgtctctattaaaacttgtaaaattttgtatttaaaaaaaagaacaaataaataaaactattaggtttgtttttttttaatccctgcgctctgattcaataactttccacatagggtcttgagcactgaaaagtttgaaaaagtgagtgataagaacctagtccaactgttgttaaaatcccagataccttcaccttgaaaaataaccagtggttaaatgtcacctcccccacccccccaaccccaaagtcattggtcatcaggaaaaagtggcaagtacctgtgttatctggcatggacgcctggtctgtgtttctttccttcttgaagacgatatttccaagctgcaggaccgatgataccaccttcaatatggctgaggtggggagagaagggcagagcagacacaaaggtcaatgccaaggtaccctggagttttggagcctaaagccactggggacccagagccagcttacatctttcctctgaagaaactagattctgagctcaatattttcatatggttgcttaaaaccttgcattacaatggaatgccacgcagcagggactggcaaattacagcccatggaccaaatctggcccactgcttgctattatacataaagttttagtggaaaacagctatactcattcatttacatattgtctgtaactatttgcatgctacactggcagagttaatgagttgcaacaaagatcgtctggcctacaaaggctaaagaatttactatctgaccctttacagaaaaatgtgttagcaacccctgccacagaacagtgagaatgaatgagctacaactaccacaaatcaaaactgatgtattggggccagcatagtgactcatgcctgcgaccccagcactttgggaggctgaggtgggagaactgcttgaagccaggagcttgatacagcctgggcaatgtagggagatcctgtctctaaaacaaaaaaaaaaccctgacatatcttccagacacaaataccgaacaaaagaggacagatggaaacaagaacatactgtctaagtccatatatagaccgtccattcaagaagaggcaaaactaatcgatgctgttagaagtcaggataatgattatccttaattgagggaagttcttagaaggtgcatgtgggagcttccatggggctggtggcattgtcttatttaaaatggattctagttacacagacgtgttcagtttataataattctttgcactgcacgctatggcatacacaattttctccatgtaaatcatatgtcaataaaaggatttttgaaataaaaaccctgtgcttcttacatactcttctgggtgtaacagatgcccatgttgggatgaagaagatatacatttgtttccacttgttgtccaggtgtctccaaacaaaaacgctgtgttcccagaatacttggaacctttctgactccatactcaggccatgttactgttaaaatagtttctatgtctgaaatccccataagaccatgagtttctggagagtggagggcctgccctaatcatctttgaatttccaaagcctattccaaggtcctgatacacatgggagggagggagagagatggatggatggtaggtggaaggtggatggatggatgaatgaataaatggatagaggatgggttcatggatgaatggacggatggatggatgggtgggtagatgaatgggtgaatgatggacggatgagtagaggatagatggatgaatagaggatggattgatggatgaataattcatggatagaggatagacggatgatggatggatggatagaggatagatggatagatggaatggacagaggattgatggatagacgatggatagatggatggagaattgatggaggaatggatacagcattgatggatggatgatggatggatgaatggatggatggacagatgatggatggatggtagatggatgaatggatggatgatgattaatgcaaattcttggcttagcttaactcaggtacaaatcacccagagttctggcttcaaatcagtcactatgttccaggaacaaagcctagagatcccagacttctctggttcctcaggccaaaccagacattacaaggcccttcacaacagctattctcacgccatggggtccctggcccagctcagcaaaaggacccagctgctgaccacccatccatttgctcccacttactatggtagaaagccttctccccaaaatgaatgaagctgctgttgacagggcttggaaacacacttccttttaaccataacatctatgaaagagtctttgtaaactatgaagagttgcactcacagttttaaaagtgtcaatttaaactaaagattcctgaaatgcctgcacagcccaggcgagccggccaactcagggtttctcaatcttgtcactgcagaaattgggggccagataattctctattgtggggagctgtcctgggtatcatgggaagtttagtagcatccctggcctctaaccactagatgtcagtggtggttaccctgacagagttgtgacaaccacaaatgtcaccagatactactcaatgtcccctgggaggcaaactcacctctggcagagaaccactggtctaaatgaacaaagccaactaatgaggactgtggggacccaaggaggccacaaacccatctgaaggggccagcagctactccgtcattgccacaggggatataagccaagtgttgctggaacttctgatttttctagataatggaaacccagagtttttatgtgaagtgtacccatgttttttggtgtgtgtgtgtgtgtgtgtgtgtgtgtgtgtgtgtgtgtgtgtgagactgagtcttgctgtcacccaggttggagtgcattggtgcaatctcggctcactgcaacctctgcgcttcccaggttcaggggaattctcctgcctcagcctccagagtagctgggattacaggcgtgtgccaccacacccggctaatttttctatttttagtagagacggagtttcaccatgttggccaggctggtctcaaactcctgacttcaagtgatccatgtgccttggcctcccatagggttgggattataggccacagtgcccggcctacccatatttaaactttaggaaccaatttctaaaaattttgaaggttgtagtggccgatctctcctgtgggctcaggaaccattggtttgcactttctggtatagttaaatgtaattccagaaatgacaaaagaatgccaccactcccaggccataagagatgaaccttggggcagaattagcagacagcaaagaagtaaaccagtgaggagacacaacacagcaagggtggtgacggctggcagcatcctggtgtgctggtgcaaagcacgcgctctgcagttagagagtcctgagttcaaatcccagctttgcttcttataaatctcattatctctgaatttccaaatcctagttccgggtccagatacacatggggagggagggagatggatggatggcagatggagggtgaatggatggatgaatgtataaatgtatagaggatgggttcatggatggatgggtgggtagatggatggacggatgggtgatggatggatgggtgatggaaggatgagtagaggatagatggatgatagaggatggattgatggatgaatcatggatgaatagaggatagagactctacatgagtctcaataagtcccatgagcctcagtttccctatctgcaaaacggagatggtaacagtagtacctgcttcgtgaagtttaggtcttgtaagatgctgagcaagggcctggcctagtaggtgataaagagtggaagccacctatattaggttgaatgttggtctttctaaaatatgtccacctggaacctgtgaatgtggcctaatttggggggttacatttatttttttttcctttttgtggataccggggtctcactatattgcccaggcaggtctcgaactcctgggctcaagctatcctcccgcctctgcctccctgagagctgggactacaggcgtgaaccaccgcgcccagcctgaacgtggcctattttggaaaaaatcggtcttcgcagatggaatcaagtacaagatctcaagatgagatcatcttggattaacctggtgggccctacatttaatgtcaagtgtctttatgatggacagaagagaagacccacagagtagaatgccacatgaaggatgaggcagagactggagtgagacaagccaaggaaaagccaggaacagccagagccaccagaagccaggacagaggcaaggaacagatctccctcagtgcctccaggaggaacaacccctgccaacatcttgtcttttaaaaaaaaaaaaattttttttttttaaatttttagtagagaaggggtcttgctatgttgctcaggctggtcttgaactcctggcctcaaacgatcctcttgccttggcctcccaaagtgctgggattacaggcatgagccattatgcccggctcctgccgacaccctgatttcagaaccctggcctccagaactgggagagaataaattcctgttgttttaaggcatcaagtttgtgctaattttttacagtggccttacacctctcttcttgctgaggaataagaaacaggactttccaacatcagacatgtgtaccaccagggatacacaggatggacaatttaggtgattttattttttatcttcaaaatacattagaagcagtataaccaggccaggcatggtggcgcatgaggatatcttgaggccaggagttcaaggctgcagaacccaatgtggtggggaaaatcctggtgtcccctggtcacttggagcctcatgaagctccagcctgaagcctgacccacccccttctccataggccccttgatggagggtttggaagtagctcttggtttataaatggggttggtgtacatttaggactaagttggttcctatgagagttcgtcatttgcacgccatcgtctgaatgcttgctctgtgtaccatctgctccattatttgcttaatcattttctttaaatttacttccttctctttccttacatttgttttaatagaaaactttctctatcttcagtgacaaatcatcttcacttgccataaatagatggcaattataaatataaatacaaggaaaacagtattaccaaattctagctagatgcttggggctgccgaaggtgctgggcctggagtctggtctctgtggttaaaggggaaacaagtgccaaagtacattgagaacactggggactgggcatggtggctcatgcctgtaatcccagcactttgggaggccaaggtgggctgattgtttgagcccaggagttcaagaccagagaatactggataacatggtgaagccttgtctctacccacccctccaaaaatcaaaccaaaacaaaacaaaaaaccccaggccaggcacggtggctcatgcctgcaatcccagcactttgggaggccaagatgggtggatcatctgaggtcaggagtttaagaccagcctggccaacatggcgagacccagtatctactaaaaatacaaaaaaaattagtggggcatggtggtgggcgcctataatcccagctacccaggaggctcagccaagagaattgcttgaacccaggaggcagaggttgcagtgagccgaggtcgtgccactgcactccagcctgggtgacaatagcaagcctccatctcaaacaaaacaaaacaaaaaccctaaaatcaaaaattagccaggcgtggtagcacatgtctgtagtctcaacgacttgagaggctgagctgggaggactgcttgagcctgcaaggcagagattgcagtgagctgagactgcgccaccgtactccagcctaggtgacagagtggtgtgatctcggctcactgcagcttcgacctcctgggctcaagcaatcttcctgcctcagtctcccaagtagctgggactacagtgtgcaccaccacacccagttaattttttgtattatttgtagagaagggatcttgccatgttgcccaggttagtctcaaactcaagctcaagtgatctgcctgccttggcttctcaaagtgctggaattacaggcgtgagccaccatgcccagcaaaacaatttaaatggtctcattgttttctttcacaaggacagacaatgatttaataaaccctctattaatcaacctattttagtttgttccagtttttttctatttattttttttgtagagacagagtctcactgtgttatccaggctggtctcgaactcctgggctcaagcaatcctcttgcctcagtgtctccaaatgctgggattacaggcatgagccactgtgcccagcctgttccagttttttattatttaaataaaactatactgaacagtgtagtacatcaagaaaaaaggatttggtaaattcctggcacacagcaaatacttaaccattgttcattgttatttaaaagcaagattagaagcaaaactgacccctgtcccaaatgaaatgaatcattcttggagggcctatgtcattcagacaaggaggctatcagcactagattctgatgtgggaccctggccaagacccacatacaccatccatttgtcaactgacccatacagcctaattttccagaccccaagttatcttcggaggagctgcccctccccttatgcagcatttcagcaacctcagtgctattctggggctccaaacgggcgtaggcgtgggaaggaagggaaactttccacagttctgtcctggtgttcctgaaagagattaaccttcaacactgaggcacatctaacgcagaaggaaaatcgtttctggaaacacagtgtcccgaccaagaatttctttctgagctgtcctgttctcaagacccagtgtgtttcttggccattggttggatgattttgatcaatatcaattgatcaccagagcaacccctccaggaaaagcctgagtaaatccactgcctcgatcactccccctcccctaaaccctgcccacatgttcctgatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatataagggctggaacccagctatgttgctgtcaacaaactgcatcctatagagaaacaatgtagtcgagagagatagaagacaagaaattaggttctagaaaaatcttttgaacacctagatctcactgtacctgaagcttgaattcctgaactttttttttttttgagatggagtctagctccatctcccaagctggagtggagtggtgtaatcttggctcactgcaacctctgccttccgggttcaagcaatcctcccacctcagcctcctgagtagctaggactacaagtgtgcaccaccagccctggctaattttttttttgtatttttagtagagacagggtttcaccaaattgaccaggttggtctcgaactcctgacctaaagtgatccgcccaccttggccccgcaaagcgctgagattacagacctgaaccactgtgcctaacctccctgaacttctcaacattctgagttagtcactttccctttggtttaagccagctcgggttacttgcaaccctagttatacagccacttttctacaacacaaacaaaccacctagaataaaattcattttcctccttttttttttttttttttaatggaaggtggggaattcagagagcagaaatctgtcctgaccagagaagagttcttaacaggttccactggtatccaggcaagctaccctccagactcaaggtgtgaggcttacatagctgctcctcctcgctgaaacccatgattgccatggcctccacggtttcctggaacatctcatcatcctgggctgctgggatgggcacaaagccattggagaggaaggtgtagttgttgaagccctccaaaagcaagtcacctagaaggagaggaagacaggtcagggtcaataagacatacttctaatttcaacatgagaccgagatctggtcaagggtctgggccatcataattcctttccctttatcaaggcttgaaccgtttaaagccctcacgcatcgtcacgtagacagcctcaccaaccactgccagccttacacagcggtgcaggttgtgcactgctccagtgactgcagctgatatccagccttggttctgcttgctaagccacaatccctggcacgaagttacatttacctggaggaagggatgcctttacctcaattgtctagaggcaccctgccttcagccttcagagacaaagctgtcagaagagttagatcaacctttactcttttttttttttttttttttttgagacggagtctcactctgtcgtccaggcaggagtgcagtggcgcgatctcggctcactgcaacctccgcctcccaggttcaagcgattctcctgcctcaacctcctgagtagctgggattacaggcgcccgccaccacgcccggctaaattttgtatttttagtagagatggggtttcaccatgttgaccacactagacttgaactcctgacctcaggtgatccacccaccttggcctctcaaagttctgggattacagacgtgagccaccgcacctggccttattcatgtatttataaaatttttatcaaattcaaacaggcacatgagttttaaaaatcaattactaccaaaggtttataatgaaaaatagcattctcctgtcacatcccttctccaactctaccttactccataatacctgcttttatctcttttagctgctttttatctggcagttaccactatctctctgtacaataggcttgctatatatactagcctattataatgtatataccattatgtattacatatcataggccaagggttccccaacccataggccatagaccagtaccggtccatgttaggaactgggccacacagcaggaggtgagcagcaggtgagcaagtgaagctttatccgctatttgcagctgctgcccatcgcttgcatcactgtctgagctccgcttcccataagatcagcagcagcattagattctcataggagcgcaaaccctatcgtgagctgcacatgtgccctccttataacactctaatgcctgataatctgtcactgtcccccatcaccccccgatgggactgcaggaaaacaagctcccaatgattctacattatggtgactagtataattatttcattgtatattacaatgtaataataaagtgcacagtaaatgtaatacacgtgaatcatccccacaccatccccccaaccctgcccgcccagtctgtggaaaacttttcttccaggaaaccagtcctcagtgccaaaagtaacaggtgcttttggcctattggaagaccagaggcaaagcacaatcgctgtaataggcgatttctggatatgtcaagtttagatagtatctagtgacttcctgctatggtaggcaaaaatgcagctttcttatactacctttcctttcctccagctatttttttttttttttttgagagggagtttcacctttgtccaggttggagtgcagtggtgcgatattggctgctcactgcaacctctgcctcccggattcaagcaattctcctgcctctcgagtagctgggattacaggcacccaccaccatgcccaggtaatttgttgtatttttagtagagacggggtttcatcatgttggctagtctagtcttgaacccctgacatcaggtgatccacccgcctcagcctcccaaagtgctgggattacaggtgtgagccaccgtgcccagccacccccagctatttttagttgaatcaatatataaggcttatatcacaggttggcaaatctggtcccctgttgtttttgtaaataaagttttattgaaacacagctgctctgatgtccttgtttatttctcatggctgctttctcactaggcaacagagttgagtagttgcaacagaggccatctggtccttaaagtctaaaacgtttactactgaccctttagcaaaaacagtttgccaactccctttttatgacattaattagatattctgtgtcaaactgtatcctatgattacatttcctttgttgttgttcagcttctcccccacccccaactttataattgcctttctttctcctgcaccatttgcttttattataccctccaatacatcaaggatcctcttccagatcaatctttaattaggatggattcggttatacttttggagagacgtcagcaagatatttttctttcaaaatcaaggtcttttatgggtcaagtcacttggaagctgcttgataaactcgaggttaaattgactgaaggcaccagttaactcaaacttttggattaacttgaaatgcctgattcaagtcacgaggattgaggtctttgccaagacttcattatcccgagtttggatgcatttagcaatatttggttctttctaaaagcctaacatctttccagttctatcatctagaatacaaacggcccctgggaatttagttctgagccctatacttgcccatttctggaagaccagaggcaaagcacaaaactggaacccaaggtaccaaacaaccaaactgttttcttgggtgccaaataaaaggaaaaggaatgtcaacatttttccctggcccattccacagggtcctgcactgtaactgctaatataccatgtttgctggtacataaaaaatccattcagcattccccctttaccaaaaattgctccacctcatagcctatgttcctgaaagccagccattaaggaaacttatttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccgagctggtctcaaactcctgacctcaggtaatccgcccgcctctgcctccgaaagtgtgggattacaggcatgagccactttgccccaccctggaaatttaaataatggataatgccaccccctagtagctgaggtctacaatacactccgacacagcgaagttctgagctcacacagatccttttggtaactgtcttaaccaaaataactaaccttgggccacaaaagagatgggaagcaaagtctgtattgttcccatagaatttcagactcaaaacttattactaacatgtagactctactatgtacagatagtcactgatccattccttttttaagctatgcgatttgtatatatttttaagagttagtaaacagctgcaggtccagaactcataacttcctactggagtttggtatacagtgtattatatttacataaaaaaacttttccctacaacagaggtcagcaaacttctgcacactgcctgtttttgtaaataaagttttattgtaacacagtgatgcatctgcactcactgatttatgtgttgcctatgttcattggtttatgtgctgcctgtgctcattggtttatgtactgcctgtgctcattggtttatgtgttgcctgagctcactggtttatgtgttgcctgagctcactggtttatgtgttgcctgcactcattggtttatatattgcctgtggctgctcttgtattacaatggcagagttgaatagctgtgccagaagccacctggcctgcaaagcctgaagatttactatctggccttttacagaaaaagtcttgacccctgttctacaaagtcactggcaaaacatgtataatgaaaaatgcttagtcctgctgcccctgcaaattccttataaaaccagaatgcatcttttatatttgcaagttttataaattggcaagtaaggcaaatgtctttctccctttccttgaaggcgtagattgtgtctagttggacttgatgctctctggtctaatgagacatgaatcattaatgatctaatgtctaattggagttgatggctactatgtcacatagtaggtgctcagtaaatgagaatgactgaacacaagccacactcactcattgggaggagatgaagaactgttcatatgtcactcacagacatggtcctttctggcaggatctgagactgttttaatagccaatcccttaaccccggattctgatgaaagggaaggctcaagccatccaatcacatgtcattgctagtcacttacttctcatcttctccttggctccagcaatcatgtagtaaaagatgtggaatgtcctctcgtctctggcttggcgaattgcccgtgatttttctagcagatctggtttggagggagttagggattctggggatactgcgggtgttcctctggtcttccacctccatccctgtcacacccaattcacatgggatgactttccagttctacccctgggatcggtaatgtctaactttgaccattgcccctatggacaaatggaaccgctgggtgctgccagcagacttcagatgcaaaaaaaagggaggggaatagagtgaaaagaaaaagcataaaaaggctccaggaagaaggtaatggtaacgagatgttcccctaacagccatcaccagcaaatcttctttaaaatgagctgtcttcagacatgacagaatacaaataatgacaccatctatgatcctatgatttatgattcattcctgtgtgaaatgattgatataaattgtctcactgaagcctcacaaagtatgctaggaaataagtgcaactattatcggtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggagagggcagctgggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttggctcactgcaacctctgcctcccggatccaagcaattctcctgcctcagcctcctgagtagctgggactacaggtgcatgccaccacgcctggataatttttgtatttttagtagagacagggtttcaccatattggccaggtggtctcgaactcctgacctcaagtggtctgcccgcctcggcctcccaaagtgctggaattacaggcgtgaaccaccgtgcctggctgagatgtgtgtttctaaagagctcccaagtgatgctgatgctgctggtttggaaacatactttgagaaccactgatctaaaaggaaggctgaggccagaaggacggggctatgcctggggctcgctctaaacacaggaaatgaattgctgagaggtgtgtgcagggctgcaggacaagagggccctggctctggacttgaccgaagcctgacagccctcctagctgcaggatgggaatcctggctggtttgggcagattaaagtagaaacgtagaaaacattgagttaacgcaatagccaccacctatgagatgctcactttgggcccagtaccgtaccaagggctgtgcatattattatgcatattatttcatttaacccctgcaccagctccagaaactaggtgcaatcacccccattttaccgaggcaaaactgaggcccagagagcttcagtgattttcccaaatccccacagcttagacaagtacagtggagaggaagctactccacaacccaccctcttatccagggcacataacgtggaaaaatgggaccactaggtgctgctagaggacctcaggtgcagaaagaagctaagtcaggcccccaggtcctatacattgccaagcacgtgttccacaggaagcctgagccctagggccgcctgcaaagctcctgaggctgatcagtcactgaactctagacctggttgttcccccacgtccagaaatttctaacttggctccacttcaccgctcaggttcatgaaagagatgctctacttgttccttgcgataccagcattcttctgggtaaactctgttttcatcaatttcctacctaagaagtggagccgatcacagaccaactctctaagaggacgacaggtccagaatttggcctcggacaatggctgaataaggatgaagtgaagatcatacgatagacactacgtagccagcccttactctgcacctcgcatggtgcctagagctttatatgagttcattcactctattctcacatttctatgaggcaggtaccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtggggcggggagattcttgcgaacactcagaaccccacaggtcaagttgtcaggcggaaccaacatctgctgagctgaaaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtgcaatcacagctcactgtaaccttgaactcctgggctcaagcaatccccttttccccatgacctcaccctcccaagcagctaggactacaggcatgcaccaccatatctggctaatttttaaatttttttttgtagagataggatctcactgtgttgtccaggttggcctcagactgctgcactcaagcaatcctcccacctcagcctcccaaagtgctgggattacaggagtaaactaccacacccagcccactatccccattttaaagctgggaaaactaaggctaaaagagatcaagtgacttgtccaacgtgacgttgctcctgagaggtagggccctaagcagaaagaaggtttttccatattcaggggctagagggctccctccccagaccccaccctgctccaaaacatccacatcatccaactatggattaaaccttttctgtgggacaggtgagtatgcattggccacactgcccaagcaggccctgtgtaggatgtcctttaggcaggaatggctcatgttcctggccctagaggctcaacaagtatctccaaagatggccctatctacctgcctcagctaagccatgaaaccaaggatggaacccaatcctccatctgttggcatgaacccttttcctgtttcctcaacaggtgagacaggatttcatccttttcccccatcatgacataacatggtgggaagtgttggcgtgtgtggacacaatcccctaggcttgctcagtccttgacaaaaccttcaaactttccccattgggaaacatgcagtagagtgatttgggatgaccatatcccagatggagccagggagagccggctggtcacaggcaaggcccaggcaccttcttcactctccttcccaagatggcagggacgccagtgagtggaggatgtttttagggatttgtcttgcacgtgcttccatttatgacaggctagaaacattgcacagaattggaacatgcaaacgcagtgcttctcagtggaggcggcacatctgctatggagattttggaaatcggtggaagccattatttggcttgtcacatgttgggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgcttttttttttttttttttttttttgagacaagagcctcactctgtcgcccaggttggagtgcagtggtgtgactttggctcactgcaacctccatctccccgggttcaaggaattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccactctgtgcctggtctagatttttatgcttttaaatgaaagcattaacaagtgtttaaaatgttgttctaatacaagaatatcccatctgtgtgactctagagaagattgttctttggttcagcgcttcactgagagtcagttgccattctggaaaatcccatgccaacatcatcagtgcctgaacttgacccttttccttgtatttgtagctgtcgccgtggatagacctaagtgtctgtctcttactgtgtcttctgttggtgtggcctggcccgagcattgatatgctgaaatgcactttatttatttatttttgtagagatggggtttccccatgttgcccaggctggtctcaaactcttgagctcaagtgatctgcccgcctcagtctcccaaagtactgggactacgggcatgagccacctcgcctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctcctggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattgtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacaggtgtgagccaccgcaccaggccaatcaatatttgttgagtgaatagtgaataaattaatgaatgaatgagagagtgagaggcaggagcccttgcaagattgtgagatacagcccatctctccagggtcagatgcccctcccacctctgcacgcaaacactctgcagccccaggcaggagatgacaccaaagcttttctggaaaatccatgtggctttgctacttacgaatcgtgaggagttgtcgttcttcactgttttggcgttgccgaaagcctccagaatcgggtttgcttgtagaagctgcttttccagctctccctaaaattcattcacatctagttattggagaaagcaacctaggtcctgacagttctaccttggatggatgttgtcacaaaactctgcccttaacccacaggttctctcctatctcctacctcctcttagaccctgatgctaatgttcagatttacaggaggatttcagaagagaagcaactgtctgagctctctaatagctaggacatctgctccctaggaaggtcacttttttcaagaccagggcctgctcatctgtgcaacatcactgccactcaaagccactgccttgcacaatgtcggtgatgtcatttacatcatgatgaatggtgccccccggagttgtgcagtgcaccacctgtcccactgtacatggcagtcgtgctgctgttcatgtttaacaagcagccttcttcaagttaaaccactacaagcctccttctaattattttagtgcaattttttttaagttgcaattttttctttctcaggactggttttctgaagtcttctacagcagacaagtaaggaatgcacaaaacccaccaggaatcctcttagcggactgcggaataaagcttcaaagcaggttgcctgagctccattcattgggttaaaggaagctgagactgtacacagcccaccggccccctctgccgggatgcctttgcacaaacgcggtcacgtgattaatcatggcaggaaagggccaatgtggtaagttaagctgggaaagcaaacgagctgctcttggcctagccctaaaacatggcggctgcagttgggccccgaggcctccaggccctggattctgggagtttttctccttgtcctcccctcctgctttcccttccttatttttccaggcatcagggctgggctggacaggagccgggaaagtgtctagaggggacaaggatgggcatggcttcctcctcattcctccgcatgctaggaaggcatcagggtacctggtctacaggacaaagcaggaagctgctatttgtttctgttttgatttgtccacacatcctcctttttgtagctcccagagaaagatgaagcaaaagcctcatccgcatacaaatctcagctacaagtggaatcaccacagctgagactggtggaaatttacaaggagcaccacgggcatttctttgttggtgggaagacgactaaaggaatcacttttgttcacataaacttggggtctccatgctctctgaaaaaggctccctttctagaatggggattctggcaggtaaggttgaaaagtcttggcaagagagctttaaatcgggggacctggttcaaaccctcaattttatagatgatgaaaccatagccccgaggagttaactgactcggccaaggtcacacaaaagcagatcccaaataagaactgtaattctccttctgatctgcaacacagtcacccagggtctaactaagatggattgaatgatcttttcgggagccaaggaagacacctgtgggtttcttctaggctgggacccacacatcagccccccaagctctgtgttagagatgagtttacatatgcacaggtccaagcaggaccaggttatgcgttgcgtagctggggccttaccgcgccaccaaagctagtgcatcgcgacctccaagactgtttctggaggcttgagtcaagcaaccagcatgcaagagacagacacgcactgcacacgcatgcacagggacacactggtgcaccagggacagggctgagggaagacacttagggatgatggcagggagagaagagggaggcatgccacagctgtgccatcgactgtccatcgagccagggaagctttggggcctgacagtcctaaaacactcagccagatgggacagacatctctgtctaggttgttccagtcaagggtaccaggagcggatgctttgaagggtgcaggggttcattctgaaccggagaaatccatttcaggctggagcgcaaccctggggactccaataggcgtcccgtgggtggtaaatgcacccccacacccttccctggcatcagacacccacaggatggtattttggtgcatttactgatttaagttgtgaaactctagggcctaccccatttctaccaccagctacgggactcggtgggtgcaagaggatcatgcagatctaagttcactccgtgcctcccctacacaccaggaaaacactctcagttactcacgtaggcaaaagatgggccttgctgtggttgaacaacacagtataaaacaaatgtcagcgttatttccatcacatggacatcaggggctggagaatatatgactttgatccccccaaacagcctggagtctcccagacagactggtcagctccttttccttgatactgtttcttttctctctgtttagctgcaggaatacgatcacagctcactgcagtctcaacctactgggctcaggcaatcctcctgcctcagcctcccaagtagctaagactacaggcatgcacaccaggcccagctaattctcttgatttttttttttttttttttttggtacagacagggtctcactatgtcacccaggctggtcctgaactcctgggctcagaccatcctcccaccttggcctcccaaaacacagattacaggcatgagcccccatgctcagccattccctcctttttctaatttcttagagatccagacatttcaaaggttttcataattactggggccacattaggctccttaaaacagtatccagtgagacaatgtctgagatgtgtttacgcatgcagccaaaacaagcagcacatagtaggcccttgataacgatgagttgttagaaagtattatctcctgtgtttactctttagggaaagggaaggcagtggaaactgtgtttaaactgccacacagcctctggggccattgttcccactcactatggctggaaaccaacttgccagagacaattctaggatgctgaatcttgagtttcctgcatttgtttggagaaggaaagttctccaaagccacgaccagcgcccatcctagatctccaagggcctccagacaagccggccatggtggctgccccagagtcccctctgaggacgcaaagtgacatctggaatggcgaacactggagacaccccatgccgtggtcagatctccatcctaccatcttcccacccacaaacctgcagacggaggcaccggccagtcctagcggccctaccacgtgccccctcctgtgggatagatggggcagggctgacacacgaggaggaagagaaggatgggccctagaggtgatgactctagaaacctgctcttcttttcctcccaagctcttagtcataccgtgtcatcatctgtttatttgagggattctttgacaactacatgctcttccacaggtctggaagctcagagaagagaataacagcatctctcagacttatccccaggtccccaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcaagggcaactgtcccaccccagggaacatctgacaatgtctagagatatttttggttgtcacaactggagggaagggggctgtcggcatctggcgggtcgaggccagggatgttgtgaaacattctacgagccacagggaagcccctccaaggaagagttatctggtccaaaatgacatcagtgccaccactgagaagccccgacgtggaggaagatctcgctatggaaggaaagggcttattctcatttcacaaaacgggcccccttctggagggatgcttctagctgagccaagaaatcacccacactcaacaggcctgctcgccaaaaagacggtccctctttgagtcttcaggggaggggtagtcagatggggcctgagttcttgcaatgatgttctgtttgtatctcggttgggctgcaagctggagaccggttggctaaatcatggcctctgattgggaactgccactcaccgtgatacttgtgtctttcttgcccttgtgggaggaggccaccacggccaggtactgaatgaccttcttggtgttttcggttttcccggctccagactcgcctctgaaagacacgggaacatcatctatgcacacgttccatggtgacctttccgcagttccatgagccaggcaggacaataatgatcatcaccaccatttcccagagggtgaaacagaggctcccagaggggaagtaacttgcccaaggccacatctctggtagtgagcggaactgggtccccagcctaggtccaatgcccaatctattccttccaagaggacatagaaaagaattcagatacaaagagtgaaaaggtgggccggatgtggtggctcatgcctgtgatcccagcacttggggaggctgaggtgggaggatcatttgagcccaggagtgtgagaccagctcagcaacacagagagacactgcctctagaaaaagatttaaaaattagccaggcatggtggcacatgcctgtagtcccagctatttgggaagttgaggcaggaggatcactcgagtccaggagttcaagaccagcctgagcaacacagcacaaccctgactctataaaaaataagaaaaattaaccaggcttggtggtgcatgcctgtagtcccagctactcaggaggctgaggtgggaggatggcttgagcccaggagtttgaggccacagtgagccatgatcacaccactgcactccagcctgggtgacagagcaagacctcatctctaaaaaaatagagtgaacaagaaaaccttagttttcttacataggtccaaacaggtttatttggaattatctacttttttttttttttttttttgagatggagtctcactctgtccccaggctggagtacagtggcacaatttcagctcactgcaagctccacctccctggttctcctgcctcagcctcccaagtagctgggactacaggcacccaccagcacactcggctaattttttgtatttttagtagagacggggtttcaccatgttagccaggatggtctcgatctcctgacctcgtgatccgcctgcagacatcattagcattgctagaaatggaaagaccaggcacaaggcagccttcaagaaaggatgtaagtgcctctggagtaccaggacctaaagtttaagaagctcccttatggaaagaaaaatttaccaaaaaaccggttatcccattggtcactgggcagatgcaagcccctttatcctctgaggaatcccaccccatgtatcaggaagctggctgatgatctcagccaagtatctaagaataaacccagttgaagtaattcacactaaagtgtaaatgactgatatgtttagatcagcacgacatggtttgtcgtatcaaaaaagtatgtcctcctggaatatgaaggtagatcttttttttttttttttttaccaagatggctttcgtgcactagctgcctgttttggccaccagaaatcatcacaatggaaccgctccatccagatactgcctctatgttccaccactcctagtgaaagataaggacagtgccttgaccaaaacttcacttgtttatcgtcttcttctatttttcagtttacttttgttttttgtgtttcctttctttgccttatctcttttattttctgagctcacttaatactctaaaatataagagagttttttttttaagttgaaaaaagaatttgttcaccccgaggtcagcccaaggttctctgtgctgaaccagtgccaccaaagctagtacagtctctgctcttcttcctaattaggaaataaagaaattaattttctctgccaaaggcccattaataacttggctcatggcttaaaaaagaaatagaagaaaagaaaaaagaaagagaaagaaaaaaaaagtgccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaattatttcctttatcctcttcctgcttccatgttattatagaaggaagagtcttgcccagagtgggtaagcaattttccctaggtcacacagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatcttttcatttactctacccagcaatctaatgagagagttattaattatccccatcacccatccggggaaactgaggcaaagagaggtttgaagtaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttacttgccccaatcaatgaaccaagccactcagtcattcacacctaagtatgaattacttcaatcaggctaacgtcagaaccttgcttgacttcattctaaagtgaaggggttggattctgattaaagcaagagaaaggagagaaatttttggatgtaggaaaccacttgcgtaggtggtcatgaacctattcagatccaagacaagaatcaggacagcagtgtgcacaaacaacatgtgtggatcacactcttcatgctgacaaaccagtgctcctagactgctgctgctcacttctcctttcccacaatagttccttcctttccaccctggccttgaacctctctcacctcctcccttttacaacaaagacatcaccgggtgtggtggctcacgcctgtcatcccggtactttgggaggctgaggcgggtggatcacttgaggtcaggagttcaagaccagcctggccaacatggtgaaaccctgtctctactaaaaatacaaaaagtagctgggcatggtggtgggtgcctgtagtcccagctacttggggagctgaggcaggagaatcccttgaacccaggaggcggagattacagtgagctgagctcgtgccactgcactccagcctgggcaatagaatgagactccatctcaaaaaacaaacaaacaaacaaacaaacagacagacaaaaaaaaaaacaaagacatcaatgtgccctatccgtggctatggtctcccactttgcctgggatggggagtgggacataaactctgggcatctaccccttcccatgttgctgctgggctccactgtttccaagttctgttgagaaaaataaattgccctgggaggttctgccaaagaaaacatcccaagctccaggctcgtgggcgtctgaaggttgatgtgcttagagctggttctagaaacattcatagcttggcttttctgacccctgacctctaggggtgaagatgccttcctggtctgagcaccctaaactcctttcttatttcttggggaatttggtactgagctccctcttcccggagaaggaccagactcatgaccacgttatggcctcctggccttgtaactaccccagtgccaagtccttttaatcagtccagccccagcagctgggaagaaccacccaatggccacttaatcccccagccaggctggcttcatgagtgtgacctgtaccgtctcacagggaccaccctgtgcttcatactctaatgttgccatctggaaattcttcctaattctttataaacgctctgcattttttttcttttctttttttttttttttttttgagactgactcttgctctattgcccaggctggagtgcagtgtgtgatggcggctcactgcaacctctacctcccaggttcaagtgattctcctgcctcaacctcccaagtagctggaactacaggtgcccgccactatgcctgggtaatttttatatttttagtagagatgggatttcaccatgttggcgaggctggcctcgaactcctgacctcatgtgatctgcccgcctcagcctcccaaagtgctgggattccaggtgtgagtcactgcactcagccagcattttcattttgcaaaattctacaaattctgcagctggtcctggctcccagggtcgaatattgccaagtccattgcagcctgtggtttgccactggtaggaaagccaaattgtctctgatgaacctcacagctattcagtccctggtctttatgtgactggcaaagcaccctggcattttgtactgtacaactcctacacgtcctgcaaaaccccaggcagaagcaacgcctctctcccctatagcatcaattggcagaatagcataatgggctccaggaccaggttgctcaagttcaaatccctcctctgccagttacctgggtgaccttaggcaagtcatttagcctctccatacctcagtttctttaccccattataaaatgggtataataaaaacacttaccttgtatgatttttttttttttttttttgagacaagatctcactctgtggcccaggctggagtgcagtgatgcaatcatagctcactgcagctgagaattcctaggctcaagtgatactcctgccccaatctcccaggtagctgggactacaggtgcacaccaccacagctggctgatttttaaattttctgtagagacaggggtctcgctatgttgctcaagctggtctcgaactcctggtctcaagtgatctctagcctcagcctcccaaagtgctgggactacaggcatgagccaccatgcctgaccttttatatgattcttatgaggattaaatgagtgaacatttatataaaatgcttagaacaatgcctggtatgccaaaatgttagttattattacttttgttttttgagacagagttttgcttcttgctcaggccggagtgcagtggcacaatcttgactcactgcaatctcgaactcctgggttcaagtgaccctcccacctcagcctcctgagtagctgggatgacaggcatgtgccactacacctagctaattttttgattttgtggggtctcgctaagttgcccaggatagtcttgaactccaggcctcaggcaatcctcctgcctcggccccctaaagtgttgggattacaggtgtgagccactgtgcccacctattattacttttataaccactgcttccacagaagttatatattgtttgtataatgattttcagcattcatcctatcattacaatataaataatattcacattttcccactgtttaagctaggagttagcaaactctttttgtaaaaggtcagacagtaaatattttagactttgagggtcacgcattctttgtcacatctgctcagctctccactgcagcacaaaagcaaatacgtaaacaagtgggtgcggctgtgtttcaataaaactttatctggaacagacagacaagggcctgatttgacccactggttaaactttgtccttccttggcttgagtcccttagcacgttctcatccatttcatttatttattttattgttatatatattttttgagatggggtctcactgtgtcacccaggctgaagtgcagtggtgcagtcttggctcagtgccaactttctgcctcccaggctcagtgaaccgagatcctcctgcctcatcctcctaagtagctgggactacaggcacatgccatcacgctcagctaatttttgtttttgtagagagggggtttggccatgttggccaggctggtcttgaactcctgagctcaagcgatcagcctgccttggcctcccgaagtgctaggattacaggcatgagccaccatgcccagcctgtcatccattttagacgaaagtttaaactcctccccagggcctggaagcacccccttacctctctctaattttatgtgaaaccaccctcctcctcttactttagccccctgatcacacagctctatctccagccaggcccatggcctctaattaaactgattatactggatggattacatgctagacaaaatacaactcaggcctaaaaattacatttattcagctttcagtttccttcctttcttgtcttccttcccttcctttccttccttcctgtctctgggtcttgctctgttgcccaggctgaggtgcagtggtgccatcatagctcacttagcctctaactcccaagctcaagtgatcctccctccccaacctcctgagtagctgggactacaggcatgcaccatcccacctagctaatttttaaattttttgtagtaatggggtcttactgtgttcctcagtttggtctcaaacttctggcttccagccaccctcccgcctcggcctctcaaggccctgagtttccaggcataagccaccacacccagccaattttcagtttcttttcttttcttttttttttttttttttttttgagacagagtctcgctctgtcacccaggctggagtgcactggcgtgatctcagctcactgcaagctccgccccccaggttcacgccattctcctgcctcagcctcctgaatagctgggactacaggcacccgccaccatgcccggctaatttttttgtattttttttagtagagatggggtttcaccgtgttagccaggatggtctcgaactcctgacctcgtgatccacccgcctcggcctcccaaagtgctgggattacaggcgtgagccacggtgcgtggccaattttcagtttcttttcttttcttttttttttttttttgagacagagtctcgctctgtcacccaggctggagtgcagtggtgcgatctctgctaactgcaagccccgccccccaggttcacaccattctcctgcctcagcctcctgaatagctgggactacaggcacccgccaccatgcccagctaatttttttgtatttttttagtagagatggggtttcaccgtgttagccaggatggtctcgaactcctgacctcgtgatccgcccgcctcggcctcccaaagtgctgggattacaggcctgagccacagtgcgcggccaattttcagtttcttaactgcataaccaaacagttggctccagcctggcttctcttaagcaccaactacgcgtaaaagctcagccctgctgtcaacttgtaggtccttcaagtcactttggctgaatttcacaacaagcaaaataaaattgaatacagagactgaagatgttggtggttctgggctgactggatgcatttgcaaataaaagtctgatcgttttgggatttccttcctaacaatggctaaggcctccttctccagcactggctgtgtgtgggcagtgtgccaagtccttgctaacgctgcattccaggagatggagatacacaatagccaagtaaacaaataatcaagatagttcgtggtggagatatcattgctacatctgggtgatgtgactgagaagatcgaggggaagggaggagaggggaggctgtggatggggaagccagggagttgctgagccttgaaagttacaagagagccctgtgggaaggatggagggaagggtgggccaggcagggcaaacagtatggacagaggtccaagggagggaaatgctgggcccaggtatgagacagaatggctcccagcatggctggagggccacaacagaggaggacagcaggaagtgaagagggaagagcagatcacactcagtcttccaagtcacagtaaggaatctgagttttattctcatgggtgcaggaaaccatttcacgaggggaacgggactttagaaccagtgtggggagaatcagaactgcaggatgggctgggcgaagtggctcatgcctgtaatcccagcactttgggaggctgactgaggtgggtggatcacctgagatcaggagtttgagaccaggctggccaacatggagaaaacccatctctattaacaatacaaaaattagctgggcatgatggcataatactcgggaagctgaggcaggagaattgcttgaacccaggaggcgggggttgcagtgagccaagatcgcaccactgcactccagcctgggcaacagagtgagactctgtctcaacaaaaaaatcaacaacaacaacaaactgcaggatgggccaggctcagcggctcatgcctgtaatcccagcacttgggaggccgaggctccccgggtcacctgaggtcaggagttcgagaccagcctgaccaacatgacaaaaccctgtctctactaaaaatacaaaattagccaggcatggtggtacatgcctgttatcccagctactcgggaggctgaggcaggagaatcacttgaacctgggaggtggaggttgctgtgagccaagatcacgccattgcactctagcctgggcaatgagagcaaaactccatctcaaaaacaaacaaacaaacaaacaaacaaactgcaagatggatactggattgcaggaaggatttttaaaaaatagtgagcactttcactacaatagcagctgatccttacaaagtgctcaccatggggcagtggcctgtttctcagttcttcacatgtagtgactcatttcatccttccaacaacccaatggggtgcttattgttcccattttacagatggggaaactgaggctcagagaagtgaactgacttatttcctggagcatacaactaactagacgatgatggggccagaattcaaacccaaggggttaggttctggaatccacactttatgacagcatgctaatgaatatttattcaatgaataatgagtgaatattcttataatgtatatttattaaaggaaggaagcaagcaagcaatgggagcagggagcttaagagactgctacagaggccctggtgagaggtgacgggaccctgaactaggaagaggcggtggagtcagaggaatggacagagatgagaaatatttcagcatcataccgtccaaggcaggaaccgctatctaaattaactaaaatcttaaaaattcagttctgcaatatacttgccactttttaagagctcaattaagtgaacttttaagtgaactttgtgctcatcacaaagttcttttggatagcaccgttttagatgaaacagcacctgctgatggcatgggtgctggaaatgagagcagggtggcctcttcttcatcttcacagcctctccataagctcagctcagagaggtcaagtgacccgtgcatagctacatagctaggaagccatctgaaagtcctactctttcctgcacctctctgttaccacacttaattcattcactcaacagagggcagttgagctacactattttggttcctggggagatgacatgtggctcacacatgggtttggctcctaggggatcaaatgcctctgtggctagctgaaaaacagcccccacaagaatgtccatggcctatcctcagaatctgtgaatatgtttgcttgagatgaggagactgtcttggatcatctaggtggggctaatataaccacaaaggtactgggccttataagagagaggtagggggaccagagaaagagatttgaagataccatgctgcaggatttaaagatggaggaagagaccatgagccaaggaatgcaggtgacccctagaagccagaaaactaggaaaccaagtcggcaggttgttttagcatttatatcctcatagctaggtagcattatatctctagatccagactattcattgtcaaacatcaaatgtgtacatcctaccatggaatatgagaattcagttcccatctaatcctcttccctttccccacagagccaagtccatcacagggagttattctggttagataaatactccaaacttgcacagctgggctccttagtccaatgtgattacttctccttccatcccaacttttgttttttcctggagtttataattgcctttgttttattgtttccaggttttctatctatatcaaccccaaacttattaattgtttcaatcttctctcaatacagttcattgccatcctaccatccatcaccatctgaaattctaattactagtttttaattgtccttccagataatttcatgcaaataggaaacatatgcacgtccatgcaatcctgctctttttaaagacacacacggttacattatgcatatgctggtttgcccctgtgttttccactcaacggtattatctataaagagcgttctctctcagcataaatagatcagcctcactctttgtagtggctacctggaaatgctatattttatttaaataacctctgttgattatagctttagttgcttccagaccttcaaatatatatatatataaatataaatatattaaatataatacatattatatattatgtaaatatatatatgcacagtctatcctcattatttatatattctatattttcaaattcaccgacctgctgaaagttatttgtaaccccaaaatcaatattcatggcacttttgtagtcatttgtgaacatgtgcagagtaaggaaaattcgattcccccaatgcacacgttcccagctcaggttgaacaggggaatgctctaccttctagtttcaactctcatactgtaaacaagtgtcctttctgtagtgtatttagtgccacctttttttgtatttttgtggctttttgttagttattttgcagtttaaaatgtcccctcagatgtgctcccttcggcagcacacatacaaaaatgtccccagcatagtgctcaagtgttggctcatgtttccaagcacaataaagttgtgatacccattatgtaataaatacacatcagataaacttcatccaggcatcagccacagagctgctggctgtgagttcaatgtcaatgaatcaacaatatatattaatatatgttacttgcatataaatacaatagtgaaaactctctcaatgattctaaaattgagttactatcttctgcctatgtacctaggtcttcaaagaaacagtgataccaatcaccaaatatggcactgatgtgtttgtggcttgataaatgtgaaatactaaagtgacagtttaacatcttccctatcaacacagatggctgttatgcaattagataagattctgcatataaaatctttagttcaagtcctggcacagagtacatgttcaataaatgctagttttttagaaggaggagaggtatggaaccaaatgatagcaggtgtcattaagagtttaagtttgcctgcctccgcagaagaccatatatcacaaatgtttagtgagcatctacatggtgccaggtataaagagaggcacttggaaccatgaacaaatcaaagatctctgcactcatggatcttttctttcataggttggatctcgactacagattaaaaaaaaaaaaaaacaaaaaaaaaacagaagaaaaagcagttccacttacgtgcatagaatggactggtcctcccgatctgcaaacagaaagaagaaaaaagagccatgaattaaaatgagctctgagctaagggtctggacttggctcctcccagggccctcccattctaaagcttctccatgctggcctcattggaagtgacaacaggtcagctgggctcattgcccaggctacaggggccacgaccaaagccaaaagggcagccccaaagtcccagaggcagccccagaaagatgctggagcctgactgatccaggagtcattagcatccagccacatcagctctggaggtgtcccgggaggcccaccccacccagattaggttagggaccaaacgcagatgttggatctatacagattggggtcccccttagccacttctccgctctgtggccttgggcaaatattcttaaactccatgcctcagttccttcatctgtaatatagtattgtgcacatttgtgtttttttgtaaatccagcatccatttcctcttcttccagaagcatcctgtggtccttgaggtttcccccatcacccctaccgtcatgtacagtcttagtgggactgcctcataagtaccttcaacaaagaggtaagaatgtgttccaggctgcattggtcagactctctggcctaaaactccaagctcagtcaaggacagggaagcacagcaggtggacagagccctgaggcagacttcctttctgcccctgggcccaagcagcccagtttctgtcatttacctagcctgattcctagtgttcccactgcaactgtgagctcctccatactcccctacaaatccctttcctctactagatgacagagtcagtctctcttgtttaccaccagagaaacccaaaagatacagaggtcatcaaagaactagatgtgattaagcagacattatccatcaccttctactcttaaagaggcctctgaggtggagccaggctctgaagacccatttccttcccaaagagagatctgagaacagttaccaatacgttcaatggtcacctaacaatgtagaaatcccagcatcatatctgctggtagacaatgccacagtggcaagcatttcttaaatccactccctggcttcagtcctactagttcagtgctcagctctcacaagcttcatttcatcaaaaatctcctaggcttggttttacattgtatctctagtactggcacatagatggtaggtgctgaattatgcttgttagatggatggattgagggatggatgagtagatggatgggaagatgagtggacggaaggaaggaagaaaggaaggaagggtagatgggtgaatggaagggtgggtagatgggtaggtagatggatgggtgggtgggtggatgaatagacagatggacgggagggtggataagcagatgagtaggtgagtaggtgggtgggtggatgggcagatgggtgggaaaatggatggatagatgagtagatggatgggaggatggaagaagaggtggatgggcaagtgagtggaaggaaggaagaaaggaaagaaggaaggaagaaaggatgggtggatggaagaatggatggataggtaaatggacgggaggataaatggatgggaggctgggtgaataggcagacagatggctggatggaaggatggatagatggacaggtagagagacaggaagacaaatggatgagtgggtgggtgggtaggtggacgaatagatggatggaaagaaggaaggatggatggatagataggaagaaagaaagaagaaaggagggaagggtgtgtagatgggtagatgggtgggtatatagctggttggacggatggttggacggaggagggaaggatgagtgagtggatgagagagtggatgggtgggtgaatgggagggaggacagagtgtataggccggtaaatgagttggatggatggatggatggatggatggatggatggatggatggatgggaatatgaatgggaggatggatgggactgaagaaggcaaggtgaaagagatgactctttcttccatctgtaatcttaagagagaactgattggatgtgggcacgttcctcagattctatgcccaactccaatcagttctctctctcttccctcggattatagatggatgtttgggtggcctggttgaacgaaatcctcaagacaaaaggcctaaagactagtcagctctggggtttcaattctggtgtgtttatataatggcacatttaaaaataggcaggccgggcgcagtggctcatgcctgtaatctcaccactttgggaggccaaggagggtggatcacttgagttcaggagttccagaccagcctggctaacatggtgaaaccccatctccactaaaaatacaaaaattagttgggtgtcatggcacacgcttgtaatcccagctactcagaaggctgaggcaggaaaattgcttgaactcaggaggcggacgttgcagtgagccgagatcgtgccactgcatgccaggctgggcaacagagcaagactctgtttcaaaaacaaataagatataaatacataaataaaataggcagccattgaaaagaaccaggcagagctttgtggatggacacagaaaaatatccaaaatatattaagctaaaaataaaagatgaggtagcatagtgttataccttttgtgttttaaaaagacagatatataggtaggatgcagtggttcatgcctgtaatctcaacactttgggaggctgagatgggaggatcacttgaggccaggagttccagaccagcctggacaacatagcaagacccagtctctacaaaaaaaaatttttttttaattagctatgtgtgatagacataccccttgtcccagctacttgggaggctgagacagtaggatcccttgagccaaggagttcaaggttgcagtgagctgtgattacaccactgcactccagcctgggcaatggagtgagaccctatctctaaaaacagacctgggatgggtgcggtggctcacacttgtaatcccagcacttcggaaggctgaggcgggcagatcacttgaggtcaggagttcaagaccagcctggccaacatggtgaaacgctgtctctactaaaaatacaaaaattagctgggcatggtagcatgcacctgtaatccaaggtactccggaggctgaggcaggagaatcacttcaacccaggaggtggaggttgcagtgaggtgagatcatgccactacactccagcctgggcaacagagcgagactccaaaaacaaaacaaaacaaacaaaaaaaaccaacaaacaggcctgagcctgaagtattgagaaaagggacaggaggaagacctactttcacccattctacttctatcctggttatgtttgtgctatgaacacatacaatcttttcctcatcccaccaaaaatggtcaatagaaaaagagtcggtattgttctttatgaaaccatcatgaccacaaagctaaaaaaagacagaaaagaaagagccaccgcattaggatcccactaacagctccgatctcccgagcactcactgcactgcaggcgtatgctgaacttctgtgttgaagtgacccactgaattctctcagcagctcctggggtgggcactggcattgcctccattttacaaataaggagagtgaggttcagaagtgaggcaacttgcccaaggtcactagggtgggttgaactgtgactcccaaaagctatgttcactcagaacctcagactgcgatgttattgactaaccaattgattgagatggggtctcactttgtcgcccaggtgggtgtacagtggcgtgatctcagctcactgcaacctcaacctcccaggctcaagcaatcctccctcttcggcctcccctgtagctgggactataggcacatgccagcatgcccggctaatttttgtattttttgtagagattgggtcttgctatgttgcccaggctggtttcacactcttgggctcaagtgacccacctgcctcagcctcccaaagtgctgggattacaggcgtgagccactgtatcccacctgtgattttatttagaataagggtcttgcagatgtaattaagggaaggatgttgagatgaggtcatcctggcttggagtgagacctaaatcaatggtgtccctatttataagagaaaggaggccgggcgtggtggctcacacctgtaatcccagcacgtgggtggatcacctgaggtcaggagttcgagaccagcctgggcaacatggtgaaacccatctctactaaaaatacaaaaaattagccaggcatggcggcaggcacctgtagtcccagctactcgggaggctaaggcaggagaatcacttgaacccaggaggtggaggttgcagtgagttgagattttgccactgcactccagcctgggcaacagagcaagaccccatctcaaagaaaaaaaaagcaggaaaaaagcaatcaaactttaatctctccattatactctggagacagacagatacccgtgcctttagcttccacccagggggagaaattcactcgaggacagagcaaaatgggaaaccagtttaattttttttttttttctgaaatggagtctcgctctgtcacccaggctggagtgcagtggctcgatcttggctcactgcaacctctgcctcctggtttcaagcaattcttccacctcggccccccgagtagctgggactacaggtgcgtgccaccacgcctggctaatttttctattttttgtagagacggggtttcaccatgttggccaggctggtctcgaactcctgacctcaggtgatccgcccgcctcagcctcccaaagtactaaaaagtgattttttaaaagagggtgaaggatagaagaaccaggtaccctgtgattagaacccagacagagagaacctcctgggaccggcccagacaacctccactatcttaaggaaagattttgagatggacagacagatgggctgtgttgatccactacttcagggagagaggcaggctttcctggcagccttgtgaatcctaggcccagagcaggagagatttataggctcagatgctcacagggcccccaggagagggagcgggctccaggagaaggcctgggagctgccagcgcggctccgagctgggggctgctgggagacctctggcctgacgttcccatcaaaaacacaccacttccaggcgtgggaagcttgcagggtgctggttacgagcagaaggactccatgtgggtgctgtctgccaacccgtgtggagcacagggaactctgagatcctggaaatttttatctgattccttccccaagcctgagcttgtgttggactcaaaagcagtgttctccaccgtacaaagcagtttcactccctccttgctttgcacaagtgatttcttctgcccagtgcacccaccaccacttcttctctggcctaatccattctctctctctctctcttttttccttccattgaggtaaaatttacactacataaaaagaaccattttaaagtgaataattcaagccaggtgcggtggcttatgcctgtaatcccagcactttgggaggccgacacagctggatctcctaaagtcgggagtttgagaccaacacggcaaaaccccgtctctaccaaaaatacaaaaattagctgggcgcggtggtgcacacctgtaatcccagctactcaggaggctgaggcaggagaatcgcgtgaaccagggaggtggagtttgcagtgagctgagatcgcgccactgcactccagcctgggtgacagagggagactccatctcaaaaaatagtaataaagataaaaaaataactaaagtgcataattcaggagcatttagtacattcacaatgttacgtaactaccacctttatctagttctaaaatattctgtcacccccaaatgaaaccctctacccgttaagcagccactcccccataagcccttgcaaccgccaatttgctttctgtctctatggtcttacctattctagatatttttgcataaatggaattataacatgtgcggcctttcatgtctgacttctttcactcagcatgtggctgaagttcatccatgttgtagcaggtcccagactttatgcctatttgtggctgagtcatatcacattgtacggatggatcatattttgtttatccattcaacagttgacggacatttgggttatttccaccttttggctattctgcatagtgctgctatgaacattcctgtacaagttttagtttgagtaccttttcaattcttcgggtacataccctaatctgtatctgaaacatcgtcttgggagtcaactcttctatgataccttctctaactctgcacttttctagagctgagttggagacctttccacttgacctcctacctgcaggatggccatggaccgtggtgcatgttgtacactgcataactctatggagaaactatttgcattggtcatttattgtattgcattgtgtatttattgtaataatctttcagcagatggaggaaaagtgctttgagaaaacggtgcctttctctaatataaacatgagtgtcacatggcctagtggttcccatggtccacaggttctctccattttagtaattatcatcattgtgatccttacttaataaatgtctcaaaacattctggcggaaaaaggtacagatgatatggaatgataataggccatctatccatgatatggcattcagagtttttcttgtttttcttttccatattggtaaaaattatggactttattcataatatccaaaaaatagaaacaaccaaatgttcatcaatgggtagatggataaacaaaatgtggtctacccagacagtgggatagtattcagccatgaaaagaaaggatgttatggccggcggccatggctcatgcctgaaattccagcactttgggaagctgaggcaggtggattgcttgagcccgggagtccgaaaccagcctgggcaacatggtgaaaccctatctctacaaaaaaaaatgcaaacattagctgggcatagtggcacaatccctgtggtctcagctactcaagaggctgaggtgggacaatggcttgagcccaggaggtggaggttgtagtaagccacgactgcaccacggtactccagctggggtgacagagacagaccctgtcttaaaaaatatataaatagtatgaatccatgatacaacgtggatgaaccttgacaacattatactaagtgaaagaagctagccggctgggcacggtggctcacacctgtaatcccagcactttgggaggctgaggtgggcagatcacgaggtcaggagttcaagaccagcctggccaatacagtgaaaccccgtctctactaaaaatacaaaaattagccaggtgtggtggcacgtgcctatagtcccagctactcgggaggctgaggcaggagaatcacttgaacccaggaggcagagtttgtggtgagccgagaccacatcactgcactccagcccgggcgagtgcagtgagacactctgtctcaaaaaaaaaaaaaaaaaaaaaaaaaaaaaaaaaaaagaagccagccacaaaaggtcacatatgattccatttatatgaaatgtccagaataggcaaatccatagagacagaaagtagatttgtgaattcgtggctgccaggagctgcgggtaggaatatggagtgacaaaaaaatgtgcacaagatttctttgggggatgatagaaatataaaattatattgcagcaatggctgcataaccatgtaaattatgagtgaatttagacagttatgcagacatagctgcaattttaggtgtgaactgtatccttaaaatgaatttatttaaattataccgcataaaccttttttaaaaatgatgttcattttataccacctctgaatgattataaatctgacttcttccacttcatgcagctctattaggtttccaacaattacaaaattgttcattttcaatgcttttcccctgaaccaatgagctcctgaaggtacaaggaacaatgcctgacacacagtaggtgctcaggaaatgcttgttattttgaattgctctctggctcagagaggcaaccaaggtagaagcaatggaaaatgcatattcacgtgttcacatattcattcaacaaacgagtcctgagccaggtaccgaaagcacaaaagtcaataagatctgcttttttttttcttttcttttttaagagatgaggtgtcactctgatgcccaggctgaagtgcagtagcacgatcatagctaactgcagtctggaactcctgggctaacagatccttccatctcagcctcctgagcagctgggactacaggtgcatgccactacgcctggctaatggtttttttgttttttgttttcattttttttgtagagacagggcctagtaaggtaacttagtaatattacccaggctggtcccaaactcctggcctcaagtgatcctcccgccttggcctcccaagtaactgaaatcacaggctcaagccaatgcaccgagcttcatgacttgcttatccttgcttttgagaagttcatgacccagggtgggagtcagatgggcaaagaaatgaccgtaagagatgagcagtgctacgatggatgtgaacccaagtgctatagacgtcaggttttttgtttgtttgttttttcacactgacctgagcaagacaggaagccttcacggcagaggtgaccactgaacagcattaagaaaaatgtgaaagaatctcctggggagaggtcgaggcagagcatcccaagcagagggcctgggacagaagctccaaagtgggcggggacacagtaccgagcctccgtggagtctgggaaggctggagctgggggcggccggccatcatcaggacccgcctggggctgagcttcccagcccagatccctggggctcatgtcacctcacaccccatccttaaacatgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgtctgggaagccagagcactgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaaggtctcagcctccattgcctgcagaaaagtggctctctacctaatgccccgcacggaggcagatgccagaggttctggatcttctgtggtgtgactgtgaaggtggccactgcatggcccttgacggtgggtcctcggcagctgactgctaatgcctgttgaacttgtcctgtccatgcaccgtgtccctacacactgaccgaatcacccttgtaacaactggagtaagcacagtcatcatcctcacgggacaagtgaggaaactgaggcacaaagtaatagccggggcagagctgggaggtgaacccagctccagagcccatgacctaagccattctgtaagtgagggcccttctctttctccagccttcatctccccactctactctcccggcagagttggttaggatgacatgctgagtaagaagagatactttgagagcctttgctgcaacccaacaggtgttttccaaacctacaggaagccctggtattgtaaaagcagaactgggctgggcataggagctcatgcctgtaatcccagtgctttgggaggctgaggcagaaggattgcttgaggcgaggagtttgagactcaaagcgagacccctatctctatgaaaaaaaaattttttttaattagctgtggacagaggtgtgtgcctgtagccccagctatttggaaggctgaggcaggaaaattgcttgagcctaggagttcgaggttacagggagctattattgtgccactgcgctctagcttgggtgaaagagtgaaactctgtctcaaaaaatatataataaataaaaacatgaaagcagaactggccagtgaaggggtgtaggagacaggaaaaccaacgctctccctcttgggcctccactcctacctcctacattctcccccttctctctgctccagccccagcagcctcatagaacctatatcaagttccctagccaagcctacacttcaccttccaaggaagcctcccctgtcctcccaaggtccccagggctacacttccccactctctggacctcctctacttagcagctacttgtgggatgattcaattcgtatttacacatacgcacagtaggctgtgtctagggcaacatctaataatcaatattgttagaatgaccgggcgtggtggatcacatctgtaattccagcactttgggagaccgaggcgggaggattgcttgaggccaggagttcgagaccagcctgggcaacataatgagacctcatctctacaaaaaatcaaaaaattagccaggcgtgatgatctgtgcctgtggtcccagctacttgggaggctgagaggggaggatcacttgagcccaggagttggaggctggagtgagctatgagtgtgccactccactccagcctgggcaacagggcaaggccttgtctcacaaaaaaatgctgttggataaagaaaggaatggggagccagactgcccagaggctgggaggacaccgagggaggtggctgacacatgcaatttaacaaggaaggtgctggccaggcactgtgggtcacgcctataatcccagcactttgggaggccgaggtaggtggattgcttgggctcaggagttcaaggccagcctgaacaacatagcaaaacctcatctctacaaaaaatacaaaaattagccagttgtactggtgcatgcctgtatgcagctactctggaggctgaggtgggaggatcacctgagcctggagaggctgaggctcaggtgagccgagatcacaccactacactccagcctgggcaacagagtgagactctgtctcaaaaaagcccaaaacaaacaaggaaggtgttgccaagtgtcagctggggcttttcaggttcactcccttaagtatgtccctttttcaatttaatatttacggtttttgtttttgtttttgtttttttttgagacggagttttgctcttgttgcccaggctggagtgcagtggggcaatctcggctcactgcaacctctacctcccaggttcaagcgattctcctgcctcagcctcccgagtagctgggattatagtcgcccaccaccatgcctggctaattttttgtatttttagtagagatggggtttcactacattggccaggctggtctcgaactcctgacctcagatgatctgcctgcctctgcctcccaaagtgctgagattacaggtgtgaaccactgtgcctggccaatatttactattttataacaaataattctcctttgctgtctcccttccctgtaatgcaccatgggtaccaaaaataaaaataaaataaagataaaaacgtgaacttttcatgattagtcagagcaccaaacagacactcctagcacctctgtaaagactgagccagccagacagagccattcattcccacacacagtcccccatcattcccaaccgggccagacacatagctgacagccactgcaaaacccacaagagacagagaagcatttggctgtaccccttcctggagatgtgtttgtagcagcactgcctctgcagagaaacagctgggaattacttcttggctccaccctatcacctctgcccccagggcccgtttcctcaccagggaaatcgacaaaaatccagacctttcaagggcatgaagatgattgaaagagactggattcagaaagagcttaaaattgttttacccacagcacatttaagagcttggtaattgccgttaatatcatctttatcatcatcatctaaaacagtgatctagggaagaggttatagacagcagtgattctgaatcggcaggacaggatattcaaccaaagatatttaacccctttctgattacaaggtgtcatggtctgaatgctcatgtctccctcaaattcatatgctggaatccttacccctaaagtgatgatattaggaggtggggcctttgggaggtgatgagatcatgggggttcaatcctcattgggggagagacccagagagctagcaggtcccttccaccatgtgagacacagcgagaaggcagcactaggccctcaccagataccaagcttgatcttggacttcccagcctccagaaccacgagaaacaaatatctgtttaaaagccacccagtctatggtattttgatatagcagccttaacaggctaagacacaaggcctatgctagtcccttagccttctgggggcctcagtttcctcttccgttatatggggacaagaatactacactatctataccacgctacccaggagggaagagtaacattctgagggcagcgaagctgggtccccaggtttgactctcagttctggggccaagtaggtgtgctgagttttccccattgatcaaatggggaggctgccacccaccctgtgtggtgctagtgagggccgagcaatgtgggattgatggagcagtgaacccaggtcctgacctattgcaggggccctgaggacatcagtgcccttcctctctctgcctctactggggagcagcctcaggggagttgggtgagcaggaaccatccccagggggctgccaatctcaagcagaaggatacagccgagtgtgggaacttgcaaagtggagaaagtcgtttggatcactccacccgcagagttgtcttaagcttaaagaggaattagccaagagccccaagctgataaaggctggctgttatttctttttttaatcccctgagtgtggccatttgttgctaatgaggtgaggacaaaacattacttgtggctatcttgcatagggcaagtgcagaggctcagaatggaatcttatctgctttcctgcccctcctacaccccagggacccatggaggggctccaaagtggttcttgtctggagggctttaatggcgcttttctcctattcatcacgttcatttattgaacttagctccagcctcctaagctttgagctgtcaacactctgagatgaagacagtagacagccttccgtgggattgagggggatccctgtggttgcccggtgtcaccgactgaccagcagggctccggctttggagtcaggataatccaagtgtatatttggctctgacacttaacaaatctgcagcaagttctccactcctctgagtctgttttcccagctgtaaaagggagctaataatagctcttgcggctagcgttggatcacccaataaaccttgtaagcatatgctgagggcacacccacacaggcatgcacgagaaggaagaatgccatagttgccatttcataagcaccacgaagataaacatcatgggaaaaatagcaactttaggctgggcacggtggctcatacccataatcccagcactttgggaggtcaaggcaggaggatcacttgaggccaggaatgagagaccagcctgggcaacacagtaagatcttatctctaaaaaaaaaaaaaaaaaaaaaaaaaaaaaaagttttttcactaggcacagtgggctcacacctgtaatcccagcactttgagaagcctaggcaggtggatcacttgagctcaggagttcaagaccagcctgggcaacatggtgaaatcccgtctccacaaaaaatacaaaaattagccgggtgtggtggtgcatggctgcagtcccagctacttggggagctgaggtgagaagatcactggagcctaggaggtcaagcctgcagtgagccgtgtttgtgccactgcactctagcctgggtgacaaagtgagaacctgtctcaaaaataaaaaagactgggcacggtggctcatgcctgtaatcccagcactttggaaggccaaggtgggtggatcacctgaggtcaggagttcaagaccagtctggtcaacacggtgaaacaccatctctactaaaagtacaaaaattagctgggcatggtggcatgtgcctgtaatcccagctactcaggaggctgaggcaggagaatcacttgaacccaggaggtggaggttgcagtgagctgagatcgtgccattgcactccagcctgggtgacaggggtgaaactctgtctcaaaacaaacaaacaaaaaacagttgtttttttttaattagctgagcatggtggtacatctctgtagtctcagctacttgggaagctgaggcaggattgctgaacccaggagtttgaggctgcagtgagttacaatcgcaccattacactccagcctgggcaacagagcaagaccctgtctctaaaaaaagcaaaaacaaaaacaattttgtcagccttctttactttataatttaatttttttttatgacatatgcctgcaccttaatagtttcagggcttaattttaaaattcctaatctggtcctgtccaccttgtaggtttgtggtaaagattaactgagaatatttctgtaaagccctgagctttataggaagcatataataaaaatccatgattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagaggggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaaaaaaaaacaaacaaaccaaaaagtgtaaaaatacatgaggcagtttaaaaagaactagagaggggagaacagcaaagccatcttggaagacagaaaatgggataagcgttgaaaagtaccaagaaaaagtccagacaccgtggctcacgcctgtaatcccagcactttgggaggccgagttgggtggatcacctaaggtcgggagttcaagaccagcctgaccaacatggttgaaccccatctctatttaaaatacaaaaattagccgggtgtggtggcggatgcctgtaatcccagctacttgggaggctgaggcaggagaatcacttgaacccgggaggtggaggttgcagtgagccaagatcatgccattgcactccagcctggacaacgagagtgaaactccatctcaaaaaaaaaaaaaaaaaaaaaaaaaaaaaaaggtaccaagaaaaaagtctaggtgagcagtgaggaaaggtgggaaacgacctaatttcaacaccgaattccccatttctgccccaaacctcagaaactggcaatgccaggggcctctggaagaaaagatcaaggaggagacaaaaacataaggactgggtcaaatataaggcactgttagacccctcccatatcttctacactccctgaagccaagtgactgcccttctcacaccccacagaaggtggtgggtttagtctctggtgagggttaaacagagggtctccgtcctggggggacaccaggaaccatactgaaagaaggaaggtataatgtacaaatttcactgcacattttgaaaccctcagcttcttttcaactagaccctcaaaatgatgctagacaaatctttaacctccaggcagaagatttttctacaaaccttctctgaagaatcagattagcccatgaacaaaagactgaaagacgaaacagaagtgtcctaatggggtagcccagtgctttcatattatagccaagcacatcagcaagcccatcctataagcactgagcttccatcaacaatttggtatcctgtgtactaaagcatccaagatgaatggatagccaagaatcccaagacatctgaagaaatccactaatatgacagacagaagttaaaacaattaggaaaatatgtatcttggaggaaatagactctgcattaaatatcctctgagaaacaggatattgcaaccacagaaaaagaatgtcatatgaaagaaacatttaaaaataaaatagaatttttggaatttaataaaatatataccagaaatttaaaacgcaatggaagggttagggaaaaaagttgaggtaagtgcccagaaaataccattaaaaacattaaagtgatgaaaatgacaaaagaaagagatttaaattataggattggtctaggaattccattatggaaataaaaagacttctaagaaaaagaaacagagaacacagggagaaagacagcatcaatgaaataatttgcaacatttcccagaatttgtggacacacgtttatagattaattgggccactaagtgtccaggataacaaataaaaatggactcatagcaagtcccatcatcctgaataggggtacaaagacagtctaaaagcttctagagaaggaggaaaaacaaaaactggtcatgtacaaaggatcaagaatattcccagccaggaaggtgaatataatcacacacacacacactcacaaacatacacacatacgaatcagattgggtttcatcttctcaaaactgaaactagaaggcaacaacacaaatgccttaaaaagctcaggcaaaaaaagttatttataactttctgaaaacaactttcttgcctgaaattttaaacccaactaaactatcctttaagtgttagagaagcatcaagcctctcagatatggaagttctcaatgcctcaagatcacgtacattctttcttgggaagctactggacaaagtgcttgatttaagcaggagagtaaagcaagaaagaggaagacatgaaaactgggaaacaaggaatccactatgaaagcactaaggggaatttcaaggatggtgaaaaagatcctatatgacagttactagctatagagaaagccagggcagatcagaaggctatagtagagatcacattcaaggagatgatatcaatatgatatccaatacatgtctggacatattaaaaggagattaacacatttagaaagagattttggggcagaattggtggttaaatacatggaaaacaagattggggaaaaaaaaggcaattgctaactccaggaaaaagaaaagtcatacagaaagaagaaaaatagtcacaaagcagtgcaaagctcagctttgaataacatctacataatcataataatgtaaactctagatagcattacatagtcataataatggaaactctgaacactgagtttgtcaaaactaagataaaattatactgggactctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaaccaattttttaaaaaagggaacaaggaattcctacatgcactgatatgtaacatcctctggcaaaatataggactgtatatatatggaatgctagtatttgtagggaaatcttagggaagaaaatagatacctatttgcttatacttgcaaaaatatctctaggagaaaacctcatacactagaaaccataattgtctcttgggagggaagctaagggtctaatgcacaagggttgaagggagaagttcaccttttgaatttgtatgtaacatctttccaaaaacaaaccacggccgggcgcagtggctcatgcctgtaatctcagcactttgggaggttgaggcgggcagatcacctgaggtcaggagtttgaaaccagcctggccaacatggcaaaaccccatctctactaaaaatacaaaaattagccaggcatggtggtgtgtgcctgtagtcccagctactcaggaggctgaggcacaagaattgcttgaacccaggagacagaggttgcagtgagcagaaatcataccactgagctgagatcgtgctgctgcactccagcctgggtggcagggcgagactctgcctcaaaaaaaaagggggggagaatttaaaaaataaacatgacataatttatgcatatgcagatataagatacatattttaaatatcagcttctcttcccataccctcaaggggcttggcttccacttgggagggtgccatgttgtgaagtatctcttagaaagtccctcccattttcccaactcctgtgaggcagcaaagggctgagctctggctctgagctccctgccacagtatactagtcaacccctctaaaccagctcctgccacactcatcatacccattctcacccctacatttatgcttttattattcttggctagaaagccatccctgcccccttctctcaccttagcaaaccattcttcgaggcttataaagccccacctctctcaaataacccaccccatccatcctgaccctggtaggttcttttctataaataactctaataattcattgattcaacaaatactgagcagctactatgtgccaggcaccagaaaatgtgctggagatacaatgatgcacatgcaagaaggatggagtttataggtcctcaggaacttactgtctatgtgacacaactgcaatgcttcatcttatattcagtgcatgtgtgttacccatccctcctcaatcccgccttttcacaccccatcttttccatgaagaactcaaggaagaagccacatgtgctagctttctctctccaccttcatggtaagcttagtgtggatcgcagcccagtgacttaacagaatgagatcgtgccatttatcaatggagtcaacacactgggcctacgtgtttcttcacaaaaaccaatttcctacttgggaatggagaaaaaattaagcaggtgaacggaattcttcccaagcttaaatttttctccattatttttgacattctttttattttttatttatttatttattttgagatggagtctcgctttgttgcccaggctagagtgcagtggcgtgatctcggctcactgcaagctccgcctcttgggttcacaccattctcctgcctcagcaccccctgagtagctgggactacaggcgcctgccactgtgcctggctagttttttttgtatttttagtagagacggagattcaccacgttagccaggatggtctcgatctcctgatctcatgatccccccaccttggcctcccaaagtgctgggattacaggcgttagccaccgtgcccgattctttttatttttggagtccgccatcaatgatttgccagaaagcaccaggtcatgccaaaatagacgagggcatagcaggtgttggttaacatttaaattaagtaaagagtttatcttttatggatgtgcatattcacggttttcattttctttctttctttcgtgacagggtcttactctgttgccaaggctggagtaccatagcacgatcatagcacactgcattcttgaagtcctgggctcaagccatcctcctgcctcagcctccagagtagctaggactacagactcacgcactgtggccagctaattatttttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctcacagttaagaggtggtctagcgcaggcatctcaaaccaccgactggtactgcacagcaggaggtgagtagtgggcttcatctgtatttacagccactccctatcactccaattactgcctgagctctgcttcctctcagatcagaggcggcattagactcttatagaaccaccaaccctactgtgaactgcacataagagggatccaggctgtgtgctccttatgagaatctaatgcctgatgatctgtcactgtctcccatcacccccagatgggaccgtctagttgcaggaaaacaagctcagggctcccactgattctacatgatggtgagttgtataatgatttcattatatatgacaatgtaatcatagaaataaagtgcacaataaatgtaatgcgctcgaatcatcccgaaccatctctcccctgcggtccatggaaaaactgacttctatgaaactggtccctggtgtcaaaaaggttggggactgctggtctaggaaagcaaaagtccccacaacacaaaagtattcttcaatgactacaagagcgatcaaactccaccgaaacctccttctccgacgattcagtggcttcaccttgccaattattgggtatcaatagccaccatcatgatatgaacacaaaacaaagtggcagttctggaaaacaaggtgcagtgactggcaaagtcagtggccttggaaaggccaaaaaaaagattcaggggccaagtgtggtggtgcacacctgtaatcccaccactttgggaggccgaggtgggaggatcacctgaggccaggagttcaagaccagtctgaccaacatggtaaagccccatctctactaaaaatacaaaattagcctggtgtgatggtgcatgcctgtaatcccagcactatgggaggctgaggcgggcagatcacaatgtcaggagatcgagaccatcctgggtaacatggtgaaaccccatctctactaaaaatacaaaattagccgggtgtggtggcacatgcctataatcccagttacttgggaggctgaggcagtagaatcgcttgaacccaggaggtggaggttgcagtgagctgagatcacaccattgcactccaacctgggcaccaagagggaaactccatccggaaaaaaaaaaaaaaaaagaaagaaagaaagacaaaagaaagaaaaagattcagggcaattcacagctgaatgaacgctaagaccacaggggctttgagagacttaaacactaaagaagtaaaagaagcccttaggaaaactggtgacccatcaaataaatctgtaagaatgatcctttttagctcgggctgcagaagtcaagcatgacatgaagatgtcgttttatgctcacatgatttcatccctcagcccagaaaaagttacagaaaaaaaccccacacccactcttaattcattttatactgaatctacaaattagcacctacttgtaattaaaataaaattcttattacatgtaagctgaaattaacctatttttataatttgcaatgttggttttcttttcttttcttttgagacaaggtctggctctctcacccaggctggaatgcagtggcgtgatctcggctcactgcaacctccacttcctggtctcaagcgatcctcccacctcagcctcccaagaagtgggactacaggtatgtgctaccacaccaaagtaatttttgtattttttgtagagacagggtttcgccatattgcccaggctggtctcgaactcatgacctcgagcaatccacccatctgggcttcccaaagtgccaggattacaggcgtgagccactgtgcctggcctgcaatgtcatttttcaagctcagtcaaatattttgcccactctctttccctcctccacacacatactatctacagtgaaactttggtctctgttttaagtgatctttttctggaacgaattatcttcagatagtaaaaatttccttcatttcatgccatttagttcagttagtgtaatgaaaggtcacgtaacaaaatgttaatggtgatgagttttggatgatagaatcataggtgccagcaagttctcttttacttaaatatatgtttaagtttttctagaatgaatatacaatattaaagactttttcaagttacaaataaattttttcagagcactgtagaaatgcttacccatctgtcgctccccctccttctcctttgctaacagaattttctttctttttggtatttagattaaaatgtgcttagtgggacctcagctccagaaaagaaccaggaattgctgggtatggtggcttatgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaagacagatacctgactccaggagccatcactttacaacctgagattacagctccaagattgcctttgcaaggctccacctgctggtctttggaggtaatggcaggccctgcctagaagggccaagattctggtcctacctgtggagtctggctcactgtcagaaagttggggcacttatacctgagtccctctatcttgggggcggggtcgtggcatctctcaggcacacctggattccggcctcaagaacttccagaattgggctcctctcaactcccaactcagatccctgggttcccacctgttggtgccctttcagagggggtgtgagttttcgagtttcttgtactcttcgcctgacctggtacacttgtttgcattaactgcctagtccctctgtttgacttgggggtggctatttcaggggctccaaagtgttctaaatagaaggtgagaaggcctgggtgcagtggctcatgcctataatcccagaactttgggaggccaaagtgggaggatcgcctgaggccaagagtttgagaccaaccagtatagcaagatcctgtcacttccaaaaacaaaacaaaacaaaacaaaaacaaaacaaaaaaacccacctttttaaaattagcttgacatgacagtccacacctatagtcccagctacttgggaggctgaggcaggagaattgcttgagcccaggaggcggaggttgcagggagccgagatggcaccactgcacttcagcctgggcgagaaagtgagaccctgtctcaaaaataataaaacaatagtaaaaataataacgtataaacatgaaagtaataggcacaagtcttaagtttggaaaaaccagcattaacaatcttcacaagaagctacaagatagagactatcaccccttttgacaaatgaggaaactgaggctgaagaggaaaagatatttacccacagtcccacaggggttgagggacaggtaggtgtcaacacagaccacaatggctcagccccagggctgttccccaccctctttccatcctttgcagacagctggcccgacggggaccttgggcagcgagccccggagctggagctggagcgggcccatgcccgtatttgcccaagctcttggctctccctcaccctcccaggctgcaaacacagatgttccttttgctttttccctttttcagccacagtaactcctggtccctcgcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcgacgatcttctccgagtagatgggcaggtgtttataggggttgaccaccacgcagaagaggccagagtacgtctgcagacagagaacccagcttacttccagacctcctccagggtagacagattgcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgttttgagatggggtctcactctgtcacctaggctggagtgcggtggtgtgaacgtgactcactgaaaccttgacctttctggactcaggtgatcctcctacctcagcctcctgagtagccaggactacaggcgggcgccaccaggcctggctgatgtttatattttctgtagagacatgggtttcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgacctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcctcccaaagtgctgggattacaggtgggaaccaccgcactcagccagagagggaatgtcgttaactgaacattggaggcatagaaagccacacacccctaaaaaggggctgtccagagggatccgcagtcatacagaaacacagctgccaaaactgtggtccaggagggagggaggaaaaggtaataatcctccaagctctctctcctcccaccaccctctgatctctttctgggacctcccaatgtccatatctaagaagaaaccccagtgactcagtctctagaagatggcagaggcatctcctcgtggcatcttcacaactactcagtaacagtgatttccccaccgcctgtttgacaggagggcaaagtgaggcatggtgaggttgtcaccaggttacacagctggagggaagttgggaactagaactcctgtttaccccacagcgcctgctcctgatcattaataccttccccatctgcaaaacagagaccaacactgacatgagctctccaatgtggatgaagcttgaaaatatgcctagtgaaagaagccaggcacgaaaagtcacgtactctatcatctcatttatgtgaagtgtctagagtaggcaaagccatggagacagaaaacagacttgtggttcccagaggctggaaagaggtgggaaatgaggaggaactgctcatgggtataaggtttccttttgaggctataaaaatgctctggggccaagtgtagtggctcatgcctgtaatcccagcactttgggaggccaaggtgggaggattgcttcaggctaagtgtttgagaccagctcaggcaacaacagccggaccccctctctacaaaaaaaaaaaaaaaaaaaaaatagctggccatggtggtgatcacctgtagtcccagctacttgggaggctgagtcaggaggattgcttgatcccaggagctcaaggtaatagtgagctatgattgtaccattgcactctagcccctgggtgacagagcaagaccctgtcttgaaattgatagctgtacaacattgtgaatgcacttaatggcactgttttctttaaaatgtttaaaatggtaaattttatgtcatatgcactttaccatttaaaaaatagcagtcctctcctactgggtgaataggagcatctgaaaataatcagatcagggacggaggagtcaaggcacaaggcgagtcccgccatgctgtacgtggtaaggcactattgtcatgatttttccttactggatactagattttcccatggttgaggtcacagttcaggagacaggctccaacccgtctcacaggaactgctttccccaaacgataaacatcagtactgcccaagactctgatggccataaagcgtatcctcttccctgcaagtgacttagggagaaccacagatccatctctcagttacagctagggtgaaccaagcaacagagggttaagtgacttgaccgaggtcaccaaagaagatcctggcagcaccaagcccagcctggcccgcccccaggtatgagcatggtccattatgctatccagcctaggcccatccaacagaaacagaaactactgatcgttcgttcattcattcattcattcattcattcattcattcattctgtacgtcccagatgccatgcaaaaggtgctgggactacattagaacattaaaaaaacacaggatcccagccctcaagggccttttagtcaagggctggagccaattagagagtgggaaagtctggctgggtgtggtggctcacaactgtaatcccagcactttgggaggtcaaggcaggaagattgcttgagcccagaagtctgagaccagcttgggcagcacagtgagacccccatctctataagaaatttaaaaattagctgggcatggtggcattcacctgtagtcccagccacttgggaggctgaggtgggaggtttgcttaagcctgggaggttgaggttgcagtaagccgtgattgtgccatgcactccagcctgtgtgacacggtgagaccttgtctcaaaaaagaaaaagaaagaaaaagagagagtgggaaggtccttccagggctcagtccactcagggacaatggtatgtaatgtctgggggtgctgcagaggaatattctttgaaggtacaggattgttgggcgcagtggttcacacctatgatcccagtactttgggagaccaaggagggcagattgctcacactcaggagttcaagaccaacctaggcaacacagtgagaccctgtttctaccaaaaatacaaaaaattagcagggcatggtggcacatgcctgtagtcccagctactcggcaggctgaggcaggagaatcacttgaacctgggaggtggagggaggttgtagtgagccaaggtggtgccattgcactccagcctgggtgacagagggagaacccatctcaaaaaaaaaaaaaaaaaaaaaaaaaaggaaacaggattgatggagacggaggttctcaccatcccctaaaaggagaatgaatgagtcaacatatgcctgtctaaatagccatcaaccatttactgagcacctactatataccacatctgtgtcagaggctggagataaagaaatcaatgatagctcctgcccttaaagaacttaaatcagagggggagacaagtacattaaaacacgtcgtaagaacagagaatgataggaacaaggaagggaaggccctaacccacattgggggtggtcagggaaacctccaggtggggaggtattccctgcactgagtcttaaaggacaacaaggtgttaaccagctcaagacaaagcagggacatgggcagaaaaacaggacacggggtccgtgggggtgaactataagcagcttggtataagcggctccatcggaccgaaatggagaagcaaagcaagggttagaggtaagcggggcccaggagcaacatccagcctggtggggctgggagtggggggctgcctgcctggacacccctcttccccattccatcacccaggaccctcccacccatcctgcaaacaccagctgcaagtgccttgagtccggggaaccccctttctcctcttcagtcccagcacaggccttggtatagaataggtgctaactaaatgcttgctaaatgcatgccaggggaataaattaatgatacagcttcctgggagcagggacagcctgacttcacctccgtgacctgggggccttgcacggcggcagtaggtactcagtggactacactgagccaggccaggggctatttcctgttcaatcagtgtcccctgtccccaggacaagcctcccaaagagaagagcccagtctgtggtcacctgaacaaaggtcaatcaagccccaccctccttcaggcctcgactccatctccagctcctctggggccatgtccactgccacgccccttttgaatgtaggtatcatttacagcccaacctgtcctcactcaagcccttgacctggaggcagtaaagggcagtggctaagggctcagaactgggtatggggtacttgaatttgaaccttcactttgctacttcttcgctgtgtgaccctgggcaagtcccttaacctctctgagtctcacttatcctcatctacaaaacagggaggcatacgaacaagcccttcatagatgtgctgcgagataatgctcgaaaagcatttagcatggcggctggtatgtagtaggtgctcaatcaatgttatttagtgactcttactatgctcccttcatttcacgagagggaagtcttgccaccttagagccttcaatatgctgttctctccacttggaacacttttcccctcatcttcccacagctggttccctctcctcttttagagctctgcctaaatgttacctcctggactgtgacccacacactactgtatctcctgcaccccgcacagtgccagggacagggtagacactcagtcagctgtaatcccagcacttcgggtggccaaggaggtcagatcacttgaggtcaggagttcgagaccagcctggccaacatggcaaaaccccgtctctactaaaaatacaaaaattagccaggcatgatggcaggcgcctgtaatcccagctagtcgggaggccgaggtaggagaatcacttgaacccaggaggtggaggttatagtgagctgagatcatggtgctgcactccagcctgggcaacagagtgagactctaaaaaaaaaaaaaaaagaaggaaggaaggaaggaaagtaagaaagaaaggaagaaagagagatgagagatagagaaaagaaaagaataaaaggaatttttaaaaagaaggaagaggccgggcatggtggctcacacctttaatgccagcactttgggaaatcgaggaggtcagatcacttgaggtcaggagtttgagaacagcctggctaacatggcaaaaccccgtctttactaaaaatacaaaaattagctgggtgtggtggcgcatgcctgtaatcccagctactcaggagtctgaggcaggagagtcacctgaaccaaggaggcagaggttatgtgagccgagatcatgccaccacactccagcctgggtgacaaagtgagactgtctcaaagaaaaaaaaaaaaagaataaaatgaatttttaaaaagaaggaaggaccacactgccttttcaactccatcactagcttctgaaagaggaatatgacttccatcctctttgtttgggacatctctcccagtgccgtgcacacaacaagcacttaatccatacttccaggtagatctgaatctctgctgagttctgtaaaagctttctaagcaagccagggtatgacgatggagtgaaggtaagactggtgcaggcagccgcacatctcacggcagggtcgtggggcttcagcatcgggctcttcctcccacattattcagccacttctccttcacctcgacccagcccaaccatagttggctgtgtttctgcctctctggccccacgagcccctctccagctggttaaattcagaggtttcaacatcccagcctcctgtgtcccagccggcatctcatgggccctgtgccaccagcaagtcccagctgcaggcccaggatttccctcttgtgaccgtattaggaagcagctccagtttttctctgacgctttatatggtcagccacagagccctgagcagggggtgctcccggggcctgcagcagaaatgaggaacagggagggaagggagggaagtggaaggaacactggctttcagacacacagggatggccgggcgcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgtgcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgggcagagtgttggctttgccttatcacctgcctgacttgtgcatacagacctacccctgagcttcctcagtaaagtgatggataatcacggcttctttatgaagctgcagtgcaatatcacggctttctaaatacccaacctagagacagacgtggtccaccaagcacgtgcttttgctgcagccttgcttttaagagcaaaaagactagaaacaacctaaatacctgtcaatagcagacaggcttaatcattatggttcatccctatagcagaagactgtgcagtggccctctctctactaccatggatgaatggccaaaatacacagttagatgcaaagattgagacgcacaacagccggggcctgtgctgccattttggaggggtgcaggaggggctctctatgtggctgcatgtgtataaaacatcactggaggctggatggagcagctcacacctgtaattgtagcactttgggaggctgaggtgggtggatcacttgaggtcaggagttcaagaccagcctggctaacatggcaaaaacccatctttacaaaaaatacaaaaattatctgggtgtggtgatgcacacctgtaatcccagctactcaggaggctggggcgggatgatcgcttgaatccagaaggcataggttgcaggagccgagatcgcaccattgcactccagcctgggtgacagagtgagactttatcacaaaaaaagcaataggctgggcacagtggcttaagcctgtaatcccagcaccttggcaggccgaggcaggtggatcacctgaggtcaggagatcgagaccagcctggccaacatggcaaaaccccctctctactaaaaatacaaaaatcagctgggtgtggtagtacacgcctgtagtctcagctacttgggaggctgagggaggagaattgcttgaacctgggagggggctgttgcagtgagccaagatcatgccacttcactccagtctgggtgagagagtgagactccatctcgaaaaataatataaataaataaataacatgactggagggctacatatgtaaccagcaaccacagtgtctctaagaaggggaactggaagggcgagaaataggaacgaagggggaagttctatattcccttatacactattttatttcatatttgcatgtcttacctattcaaaaacatatttgaagtctgactagatagttatgaacagacagaaaaaactataaggtagggttaagtggaaaaaaaatcatactgcaaaacatacaaggagtgactttttcttatgtttggggtgtgtgtgtgtgtgtgtgtgtgtgtgtgtgtgtacatacatgaacctgtgaatcatgtttgcctccagggaagagggctgctttttgtgatacatacttatttttaaatattctcctgaggtctttgcatagattatccttgtattactggaggaggttctttgaagcaataatgacttgaaagatcagaaggctgggtgcagtggctcatgcctgtaatcccagcacgttgggaggcggaggtgggaggatcatctgagttcaggagttcaagaccaacctggccaacatggtgaaaccacttctctactaaaaatacaaaaattagctgggcgtggtggcatgtgcctgtaatcccagctactgggaggctgaggcacaagaatcgcttgaactcaggaaatggaggttgcagtgagccaggatcacaccactgctctccagcctgcgtgacagagcgagactccatgttaaaaaaaaaaaaagatcagaagggctaatgcttggggcttgacaaagggcagcttccagttacagtgtctttctaccctctagggaccagtgcagtggctggcacccaggaggcctctgttcacaatctgcttgttccttgtgtccccgggtggacactgcttccagagtaggctaagattgctgggccaggtctctaaggcggaaaaattgtcacctgctaaagtttggaaggagggcttctcctgaccccctgggcattccagaagcagaaccagaactggaaaaatgtcctttggggttcatggttcagggacttgggcttggagttccaatgagcaggggggcccatccaccttggctctggatcatgattttcccaaccccagaggtttggtatagggtggagggtcccactgtctacagagacaaagcaggtaaggcatgagtgaagcagggcgtgtgtgagtgaacaaaagaggtgccacggtcaatggttaccatggcctgggagacgacagggagtggtgaggtctgcggaaaagcagagcaaaaagcccatctcacagggactgctactcgcactctgcattctgcagtgtcaggtcctctgctttttcgagcaatgccagaaacagatttctttttttgatatattaagttaactcaatttaaaaacaaaaatcactcctctgtgttagcaggttgtaatcattagtctagcacctagttaggtgctcaaggaatcataataaaaggttcaattccttcttgctctgcacttaaagcttgtctacctcaaagctaacaaggcctctggcactgtcccctcctgctccagcccacgaccatcacctcctgctctaagcctattaccccaagagccctttgctactaatcataggtagtcaccctggccctggactcacacagaccttgtctgaatcccagctctgcccaccttccagtggtgggactaagcacatctgagcttcagcaacctcatctttttttttttttttttttttttttttttttttttttgagatgtagtctcactctgtcacccaggctggagtgcagtggcacaatatcatgcctgtaatcctaacactttgggaggccgaagtggtgaagattgcttgagctcaggagttcgagatctgtttgggcaatacggtgtgaccccacctctaccaaaaacacaaaaaaattagctgggcatcgtgctacatgcctgtagtcccagctactaaggagactgagataggatcccttgagttccaggaggcagaggttgcagtgagctgagatcatgccactgtactccagcctgggcaacagagtaagaccccatctcaaaagaaagaaaaagaaaaaagaagaaagaaaaaagaagacagaaagacagagaaagaaaggaagaaagagagagggagggagggagggaggaaggaaggaaggaaggaaggaagggaggaacgaactaactaactcgaggcagacgaactcagccaaaagacagcattcagaagaccaagggacccttaggaccaggcgtcaaagccatgctccccgccaggtatgccacaaacggtcttcagcagtttaggtagactgctggacattgctgagcccagaacctgcatctctaagattaggaggaaagctcctctggcttctatagactcttctagatccaagagcacaagaggtctgccagaaccttctcaagggcacatcgtttgaggcgagccttgcagaacggaggagaaagtttatcttcatcacagagggcaaagtcatgcatgccagaccacggacctggtatcacctcactacccgcctattaacaagactcatgcatgctgctattatgggctgggagagtaagttactgtgctcccccaccccaacccctttccttctttatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatgaaagacctgggccccaaagagtccaattttccctctagctccctacagacgggcctctttagaaatatccaacatactggctgggcgtggtggttcaggcctgtgatcctagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtggaggttgcaatgagccaagatcgctccacttcactccagcctgagcaacaaaagtgaaattccatctcaaaaaaaaaaaaaagaagaaagaaagaaaaagaaaatgtccaccatacaaacagccccagatcaataatttttccatacaaacagtgccacagacaagagacttcccctacttaagaaagtaaagatacattttgcaacactgcacctcagcttccttccctaaaaggggcaaacatttttaactcaggggatgctgtgttaaataaaatacaatgtgtcaatgtacagcacttggattggaggacatatttaatagttacggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgtttgaatccaggacttggaagctgtactgagctacgatagaaccactgcactccagcctcaaagacagagtaagcccccatctcaaaaaaaaaaaaaaaagttatgagttgctaagttgctcactcttaccatttggctctttaaaaagccactctaactccttctgaaatatctataagaacagtggaaaaatggcctatccccatgacagattctatactaccccttacaaggggtatctttggggcttcctgagatatattacacaagtcaacactgagcatttccaaatggaaaaaagagcaagtcactaaactgtgtgcccaataggcttttaaatatgtaaacagataccatgctcacaaagagacaaagaatgcaccgcatctctggttaaggactaatttttctgttttgtgttcactatgctttctgaactctccaagtgttccatagtgaacgtgtcttagtttcctaattaggaaaaaaatgtgcaggacatttttagagatgacaaggggctttttgtaattttcatttggcaaaatgtacagaccagaaccaaagagacacaaggatgccaagtgatggaagaagaacatcttactagtaaaatcaaaagtgatcatgaccacagcaaaaaccaatctagtaacacttaacattttcagtgcctgcacttaacatgtagcaggaagtgtattaagtgctttctatttagagtaacccactccatgaagctggtactatttttttttttttttttttttgaaacagacaaggtcttgctctgtcacccaggctagagtgcagtggcacaatcatagctcactgcagccttgaactcctgggctcaagtgatcctcctgcctcagcctccctgagtagctgggattatgagtacgcaccactgcacctggctaatttatttttgcagagatggggtctcgttgtgttgcccaggctggtctcaaactcctgggctcaagtgagccacctgcctcagtttctcaaagtgctgggattacaggcatgagccactatgcccggctcccaagaggctggcactattcttgcatccattttacagaaaaggaaacaaagcttcagaggcatgaggtaacctgctcgagggtgagcaaggcctttcagagagaagacatagacataggccgggttgggtgacctctgcacatcagtctggcgacccgtgccccacaacatcacactccaagccccaatcatctagtccaagcagtccaacagaactttctatgataatgggaacattctgcacttatgctacccagtacaccagccactagccacaggtggctattgactacttgacctagggccaacacaacaaaagaaataaatttgttattttttattgtcttttacttatgtatttatttagagatgaagttttgctcttattgcccaagctggagtacaataacgcgattttggctcactgcaacctccatctcccaggttcaagcgattctcctgcctcggcctcccaagtagctgggattacaggcgcacaccatcatgcccagctaatttttgtatttttagtagagacggggttttaccatgttggccaggcttgtctagaactcctgacctcaggtgatccacccaccttggcctcccaaagtgctgggattacaggtgtgagcccacgcacccagctaataaattttttaatgtttcttttttttttttttttttttttgagatggagtttcgctcttattgcccaggctggagtgcaacggcaccatctcggctcactgcaacctctgcctcccgggttcaagcaattctcctgcctcagcctctcaagtagctgggattacagatgtgcactaccatgcctggctaattttggcatttttagtagagacagggtttcatcacgttggccaggctggtctcaaactcctgacctcaagtgatctacccgccttggcctcccagcgtgctgggattacaggcatgagtcgccaaacctggtctaatgtttcttttaattaatttaaatctaaatttagttagccacgagtggccagtggctaccatattgtgccatctctagtccactctgttctgcaagtctacctaaaatagtcctacgaccaacctgaacattcccctctgtgacaaggaaggcctccctaaaacctagccacatcctcatgtctcctacccacctggctgccaagacaaaccagcctttccaaagtggttatgagctcttctttactttcaagaggaaggaaggacagagaacgatgccaatgaaatctgttgagagtttatcatacgtcttggcacttggcacatgtgatgacatgggattgtcacacctcctgtctgtaatgagggtgattattcccattttacggataggaaaaccaaggcttcgagagaggaaataacctcttcaagggctgagatgtgaacccaccttggaatgattccacctcatcttgcaatctccctcgatcaaaccttcagcctcccatttcctttttttttttttttgagacagagtcttattctgtcacccaggctggagtgcagtggtacagtcttggctcactgcacctccacctcctggattcaagcaattcctctgccccagcctccccagtagctgggattacagatgcgcaccaccacccttggctactttttgtatttttagtagagacggcatttcatcatgttggccagcgtggtctcgaacttctgacctcaggtgatctgcccacctcggcctcccaaagtgctgggagtacaggcatgagccactgtgcccagccctcccaacacatttctaatgcctactttccttatgaggccaggagtaggtacctggctgcctgcaatactcacatatattagccctgagaagtaccgctccctcaggttgtgtagcacggaggcttcgttgaggcacgtcagctccgccatgtcctccaccttggagaacttgggtgggttcatcttctggatgtcatctttcccaaccgtgaccttcttgccattctccaccagctccacaaccacctcatcccccttctcctccttaatgctggctgcctcgaagccctgcttctccgaggggacccagacgagtctcttggcggcccagtcagcctgggccactgggctgttgatgaagtttttgtccacaaagaggaacttctcatcgtcactgagttggcccttctgcgccatggtgccttgttggtcccctgtggaataaggtaacagggtcagaatcagaccacaaccaagcccggaagacagaccaaccactcaccttgccctgtctaggaactcggtctgcagagacatcccaccaagtacaaagacctgcagtattgtgtatgtggtcaaagaacagagaccacccaaaggcccttcagaaagggatgtgtgtcatcgcctaaaataccaaaagtcagacaacccaaatgtccaccaacatacagctggatacataagccatgctatttccacactgtgaaatactacccagtgctcaggaggcaggaagtagggctggacaaggtggctcacacctgtaaacccaacactgtgggaggccgaggtgggcaaatcacttgaggccaggagttcaagaccagcctggccaacatggtgaaaccccgtctctactgaaaatacaaaaattagccaggtgtgatggtgtgcacctgtaatcccagccacttgggaggctcaggcagaattgctcaaacccaggaggcagaggttgcagtgagccaagatagtgccactgcactccagcctgggtgacagagccagactccatctcaaaaaaaaaaaaaaaaaaagaagaagaagccggaagtaagtgtacacgtgctaatatgggaagatggtcaagtctaactgtgcgctgcaaaataagagtcctcatacgattaaacatagaattacccagattccttgagcccaggagttggagaccagcctaagcaacatggcaaaaccttgtctctacaaaaaatacaaaaaattagccaggcatggtagcgcacacctgtagtctcagctacttgggaggctgaggtgggagaatcacctgagcctgggaggtcaagattgcagtgagccaagatcaagccactgcactccagcctgggtgacagagtgagactctgccttaaaaacaaacaaacaacccaaggtatataactggaaactcagtaaaaggaaagaaattatgcaataaaataaatgagtctcaaaagcatcatgctcagtgaaacaaatcagaaaggccacacgctctattactccttcaatacgaaaaactattaggctggtgcaaacgtaagtgtggttattgagatagaaggtaatggcggccgggcgcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacccaggaggcggaggttgcagtgagctgagatcgcgccactgcactccagcctcggcgacagagcgagactctgtctcgaaaaaaaaaaaaagtaatggcaaaatagaaaaggcatatctatggtgacaggcaatcaagagttgccagaggaggccatgcacggtggctcacacctgtaatcccagcactttgggaggccaaggcaggggggatcacttgaggtcaggagtttgaaaccagcctgcccaatgtggtaaaaccccatctctactaaaaatacaaaaattagccgggcatggtggtgcacacctgtaatcccagttactcaaaaagctgaggcaggagaatcacttgaacctgggaggcagaggctgcagtgagccgagactgcaccattgcactccagcctgagtgacagagtgagacgctgtctcaaaaaaattaaaaaaaagagttgccagtggcaaggaaaggaatggattagtaagaggcacagaagaggtacataagaggtaagaggcaccacctttcggggtgataaaagtattccctgtggtcatggtggtgcttacaagactgtatacatttgtcaaaactcattaagaatgttctatccactataggatgagtaaagtgaacaataaaatattacatcgtttccaagagctagaagaaggacattgaatgttcccaacacaaagagatgataaatgtcattatataggaagtagcaaaataaaagtaatggcaaatgcttgagatgatggatatgctaattatcctgatcttatctccccacacattatatgtattaatatcaaaacattactaagagctggactcagtggctcacacctgtaatcccagcactgtgggaagctgagacaggaggatcccttgaggccaggagttcaagaccaacctgggcaacataagaagcccctgtctctgtaaaaaaattaaaaattagcctggcacggtggtgcatgcctacggttccagctactcaggaggctaagacgggaagatggctagagcccaggaggtcaaggctgcagtgagttgtaatcatgccactgcactccagcctgggccacagagcgagaccctgtctcaaaaccatccaaccaaacaactaaaaaaatcattatggaccccatgaacatgtatgattatttgtcaattaagaaataaattttttaagttgaaaaaactcactcaagctgtacacttaaaaaaacttgaatttgttttaaatcggtgagttttactttatatagattatacctcaataaagctgattaaaatatttgtcataaagtatttgtcttcattttatatgtttgtgtgtacatttctaaaagtctagaaaactgcataccaaaatattatactagggttctatctggtcaaatacgagacagtgtgaatatcaataagaaaaataattatatgtccatcaccctaacaccccaaaaagggtggaaagacaaatatatttaaatgcatttgttcaaaatgatttttgttgttgttgtttgagatggagtcttgctctgttgtctatgctggagggcagtggtgcaatcttggctcactgcaacctctgcctctgggttcaagcgattctcctgccttagcttcccgagtaactaggattacaggcgtgcaccatcacacccagctaatttttgtatttttagtagagacggggcttcgccaagttggccaggctggtctcaaactcctgacctcaagtgatccaccagcctcgggctctcaaagtgaagggattacaggcatgagccactgtgcccagccccaaatgcattattttttaaatgggtacagaaagtggggtggaaatgtgaaaatcttgattctgcgttttctatacaaattgttccttagggtaactaaattaagaaggggaagtctctcttgatggaagattaggtcattaaatgtcctgtctacatgggaagcccatggatggtagattcacgttatctgtcgttatccagatgtgtttatgaggagagggacagagacaacacactctataggcctgtccggccccccgttcctgactctctgaccatagctgcaggggctgtcctggaaacactggcttacagccccttctacctcttgctgctgggctccaaagaactgagttgctggctaagtgaggacatatggccaccaggatctatgcgtggttgacatccctccttcagcagggaattcacaactcctttgaattcactgataatccccacgcttgggccccaaatcccacagcgacagaataaagacccatgtcccactcctggatccctagagctgagcagccaactcctgaaacccaaccttttgggtgatgcagattttgcaagacagaatgggagtggcagatattccaatacctatttttttcctttcagggctgaaaataataattaaaaaactaattttaagaacctgctgctgggtgcagtggctcatgcctgtaatcccagcactttgggaggccaaggccggtggaacacctgaggtcaggagttcgagaccagcctggccaacatgtgaaaccccatctctactaaaaatacgaaaagttgctgggcgtggtagcatgcgcctacaatcccagctactcgggaggctgaggcaggagaatcacttgaacccgggaggtggaggttgcagtgagccaagattgtgcctctcaccgcactccagcctgggcagtaagagcgaaactcagtctcaaaaaaacgaaaaacaaacctggaagttgatttgctcagagattttctgctgggagacctgatatcgtagctgatgaaaaaaaagtggcggctaggtgcggtggctcacacctgtaatcctagcactttgttggggctgaggtaggaggattgcttgaggtccggagttcaagaccagctggccaacgtggcgaaacctgatctctactaaaaacacaaaaatattagctgggcttggtggcaggcacctgtaatcctagctactcgggaggctgaggcacgagaattgcttgaacccaggaagcagaggttgcagtgagctgagatggtgccactgcactctggcccaggcaacagagcaagacttcatccaaaaaaaaaaaaaaaaaaaaaaaaaaaagggcagagaaatgaggaaatcccatctaaatctgaataatcacttcagatatccagaaagagaaataaagatctggtagacaacatgtattgtcctaagtttaacaatcctcctttctgcattttaaaattgttattgaatttggcttagctcatagtaagaccaacagtgtcctgcccctgactccagttaccctatcttaaaaaagactcccttctacatggaagaattccagcgaatacatgcagaacaataaaactaggatgtaactgtttataaagctaatagtgggtctcaagctgggcacggtggttcacacctgtaatcccagcactttgagaggcccaggtgggcggaccacctgaggtcaagagtttgaggccagcctggtcaacatgggaaaaccctgtctctactaaaaaatacaaaaattagctgggcatagtggcatgtgcctgtaattccagctactcaggaggctgaggcaggagaattacttgaactccaaaggtggaggttgcaatgagccgagatcatgccactgtactccagcctggacaacagagcaagactttgccaaggaaggaaggaaggaaagaaagaagaaaggaaggaagaggccgggcacagtggctcacacctgtaatcccagcactttgggaggctgaggcgggcagatcacgaagtcaagagatcgagaccatcctggctaacacggcaaaaccctgtctctactaaaaaaaaaaaaaaaaattagccgggcgtggtggcggccgcgtgtagtcccagctactctggaggctgaggcaggagaatggtgtgaacctgggaggcggagcttgcagtgagtgggtgagtggagatgcgccgctgcactccagcctggacgacagagtgagactccgtctcaaaaaaaaaaaaagaaagaaaggaagaaagaaagggtcttggcaagttggcaagttctaccagtaattgctaaaaccattaggccaatggggctcacatttcctggtgcattagcttctgagtcagtaggactgggatggggcccaagaatatgcattcctaaccagcttccgggtgatgatgatgatgctggtctagggtccccaccacaagactgactatatcagatgaagagctcttgtggaatttttaagggatgggtccgcctgccatcacctaaatctactaattaaccctaacatcacaaaaagagagagctgactagacattataaacattacatgcctgcagatgggccactacaggaagtgccgttaccactaatgacatattcttgctcaaaagaaaaggggatggagatgggggatgaaggtgatgaagcctccagatctgacgcctgtctatggaaaatgcaaggcacaggagagcatgctaaacaatgcagtaaactcccaaaggtgagagactatgctctgtcgcccagctagagtgcaatggcgggatcttggctcactgcaacctccacctcctaggttcaagtgattctcctgcctcagcctcccgaggagctaggattacaggtgcatgccaccacgcctggctgatttttgtatttttagtagagacggggtttcaccatattgtccaggctggtctcaaactcctgacctcaggtgatctaccggccttggcctctcaaagtgctgacattacaggtgtgagccaccacgctcggccagtactctctttctttaacaaataaaatacaaacaaaaaggaggggaacccatagattaaaaaataattgaaagaaaagaggctggcagtagcccacatgtataatcccatattttgggaggccaaggcaggaggattgcttgagcccaggagttcgagaccagactgggcattatagcaagaccccatcccttaaaaaaaatatcagccaggcatgatgatgcgtgcttgtagtcccagctactaggaggctgaggcaggagggttgcttgagcccaggagtttgaggctgcagtgagctatgattacatcactgcactccagcctgggtgtcagggtgagaccctgtctcaaaaaagagaaagccacagagaacgagaacatttcataaatatagggcattttcattagcctaaaagatctttctgagcctaaataaagtacaagttcattggtgctggcaacatttgattggttgcctcctcttgagaggtaagataacctgtagtcatgtaaagacacccagactttgcaatcagatgctaattcaaacgtgactctgccactgcagaatgcgtgcttctgggtgacttacgtagatctgagactcagatttactgtatattaatactggggacctaacgggtgccctgcagagctgccatgaagtttagatgaaactctctacaccaagcttgtctaacctgcagcccacaggctgcatggggcccaggacggctttgaatgtggcccgatacaaattcataaactttcttaaaacagtatgatattttttcgcgatttttttttttttttttagctcatcagctatcattagtgctagtgtattttacgtgtggcccaagacaattcttctttttctggggtggcccagggaagccaaaagataggacacccctgatctacaccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacaggcagcaaaataggaaatgcggcaaaatattcaatcattccctgataatctcttgtttcttaaggtgtcgcagcagatcgtgtgtgtgtgtgtgagagagagagagagaaaaagaaggagagagagagagagaaactggaggatgcgtaagagaaatgggagggtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcgacagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacaccacaaaaaaggacatctcacaacacatccttgagcaaaagaaggtggtcacaaaaagcacaggttctgtgactattgaactgaggtccaaaaccaggcagaattaatctacggtgatagaactcagataaggaatgaatgagtctccggtgtgcaatgattgcaaggacagaacgtgaggggggcttgtgagggttgacctctagatcttcatctgaatgccagccctatgagtgttcactttctgaaaattcatcaaactgttgggccaggtgacatggctcacgcctgtaatcccagcactttgagaagccaagatgggaggaccacttgagcccaggagtttgagaccagcctggccaacacagcaagacccatctctaagaaaaaatgttttttaattacctgtgtggaagactgaggtaggaggataacctgagcccaggaggctgagaccggcctggtcaacatggtgaaaccttgtctctagcaaacatacaaaaattaaccggttgtgatagtgtgcacctgcagtcccagctactcaggaggctgaggtgggaggatcacttaagctcaggaggtcggggatgcagtgagccatgatcatgccactgcactgcagcctgggtgacagagtgagacccccatctataaaaaatatatcctcttgaaaattcatcaagctgcacacttttttgcacatcaagcgtacttttttggttgtaaagtacacttcattttccttccctcttatctttaattgtggtaaaatacagctaacattcaccacctcggccacttaaacacagttcagtagcattaagtatattgatattcttgtgcaataatgaagagtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagacggggtttcaccatgttgtccaggctgaggtcttgaactcctgacctcaagtgatctgcctgcctcggtctcccaaagtgctgggattacaggcatgagccgctgtgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtacaaaaaaggagagcttggagcaggctggattccctctggctttgatgtctctgacagttacgacgtgcaaaatctgctttggtcaaaagacagcaagatgggggatgagaagcttcgactcatgctagaatggtgttttccatagcatgccccttggaaccctaattccctgaaatatctgggctggggtggagctgcggaggttgagaagctcttcaaacagtggcgcagtcaaggtcaaatccatctggaaggtgctacatattcccctttccctcattgagacacaaaacacacaacaggacacttgagtctctggcagatccggaaacctgaaagctgttttgctcctacgagccttgggtccccaaaacaacatttagccacagatttgccaaatgttttgagaatgttttcctaaaaatttgccaaatttttgagaaaattcagtgagcctgacaaattaataatactaatactagtaataatagttgctaagtcttttttttttttttttttttttgacacagagtctcgctctgttacccaggctggagtgcagtgacgcaatctcagctcactgcaacctccacgtttctgggttcaagtgattctcgtgcctcagcctcccaagtagctgggactacaggcatgcgctaccatgcctggctaatttttgtatttttagtagagatgaggtttcaccatattggccaggctggtcttgaactccaggcctcaagcaatcctcccaccttggccccccaaagtgctgggattacaggcgtgagccaccgcagctggccacaaactctgcactgtgactcttgggctgcgtcattctgtgtcgtgaggggagctcttccgtgcattgtgggatgttccgcagcatccctggtctctgcccacctgatgccagtagcaccccttcctccactcatgacaatcaaaaatgtctccagacactgctagatgtcccctggggtggcaaaactgcttccagttgagaaccacagctttagaataaaaacaagggctgtcttgggaaaggcagttaaagctgagagcagctctcacttagtcaaactcaactcggaataccaactgcagaagatcagacgggggcaaggtgaacacactggaccagagacggaccgccagttggcccaaccccagggacactcttcatctaccttgatgcaccttcccaaccctccctcctccaccatcgctcatgtttaaggtcctgcatcagctccaagggctgaaaggacatctctgaaattactacccagaactgctgaccacgaagtacagttcactcatcaagagctgctctcaatgtttttggttgggggaagggtctcactatatgcccagggtggagtgcagtggtgcaatcatagcttactgcaggctcaaactcatgggctcaagggatcctcccacctcaggtgtgggccactatgcccggcttattttttgtagagatgggggtcttgctattttgcctaggctggtctcaaactcctgatctcaaatgatcctcctgccttggcttcccaaagctctaggatgacaggcgtgagtcacctcgtccaactttctcgaatgtttggatgaaaacaaatgactctgtcacctttggcattagcgatgtttgacacatctgagtgtgtcagccttgtttacagtcctgtcctgaccaacaactgcttcattctttttttttgagacagggtctggctctgttgcccaggctagagtgaagtggcgcgatctctgctttctgcaaactctgcctcccaggctcaagccattctcccacctcagcctcccaagtagctgggatcacaggcacgcaccagaacacccagctaattttttaattcttgcatttttttgtagagacaggggtctcactttgtggcccaggctggtctcaaactcctgagctcaagcgatctgcctgcctcagcctcccaaagtgctaggattacaagcatgagccaccgcgcccaggctgcttcattttttgagcacaaacaagctaatcattagcctctggaagaccttaggatgtcaagtaacgagtctcagctttgccccaaacctgctgggtgactctggacaagtcacttgccctctctgggccttgtatttttcatttagggaaaataaatcaatggtaggctggcccagctctaccattttatgggacccgtctgtgactcccagtcaaagggctgaaactggaccaactgagaatgtcaggttgctttagtttgttttaccatcagtttcatttttcccagaagaactcaggggcaaaagatcttgccctctctgcttcagcattaataaaaagtaaattaggccgggcatggtggctgatgcctgtaatcccagtacttcgggaggccgaggcaggcggataacctgaggtcagtagttcaagaccagcctggccaacatggtgaaaccccgtctctactaaaaatacaaaaaatagccaggtgtggtggtgggcgcctgtaataccagctactcaggaggctgaggaaggagaatcgcttgaacccaggaggtggagggtgcagtgagctgagatcccatcactgcactccagcctgggcgacaagagcaaaactctgtcttgaaaataaataaataaatagtaaattaaatatcccagagcccagagagtataggatttgcacatcacctcacctggtcaacagcttccctcaggattttactgccaagccattggctaaagattttggaccagagacaaaaacccaaatgtttttggagatcaggtaagtaatacagagtgacccagaccagatgttagagtattgcttatattctaaataccatgcagggttcagcactgtggctcacgtctgtaatcccaacactgggaggccaaggcaggcagttcgcttgagcttaggagtttgacaccagcctgcgcaacatggtgaaaccccatctctacagaaaatacaaaaattagccaggcatggcagcacatgccggtagtcccagctactcgggaggctgaggtgggaagatcgcttgagcctgggaggtagaggttgcagtgagccaagatcatgccactgcactctagcctgggtgacagagtgagactccatctcaaaaagaaaaaaaagaaaaaagaaaaattgctcatattctaaatgtcataaagggctggatacagtggttcacacctgtaatccaagaactatgggaggccaagccaagaggattgcttgaattaggagctctagactagcctgggcagcacagtgagatcccatctctatttcaaataaacgaatgaatgaatgccacacaggcaaaacagaagttctctgaacctgatctgcaacacaattcgccagctggaaggacctctgcagtggaaatcctcgctcaaggcctggtccaggtgtagggaggcatcaaatgtgtcgcagggagaggcactgggcactctaaatgcacctgcttggcaggtccccagtagtaccaaaaaggcagtttagatctattattcataacagccactgtatttattgggccccttgtattcatcaggtatcaggccagacagcttcctatatagaccatctcactgtctcctaagcgctctgtaaggtggcatcacctgctattgctattttcctgctaagatgaccgaggtcctggaaggtaaatgcaagacccccacttgtaaaatttggagtcaggagtacaatccagaatctaatcctagttttctgctaagagtaaatggacacccgattaattcttagcagaaagtccctttcttgcccctgaccctactccaccatttctaccctcccctcaccattcacatccccccacctcccaagggcttgttcccaagaaagccctacttcacttttacaggaaaaaaagtgaatggtgaacctgtcacattcttattgccttgtgacatctgcctaatcatctgaataccaatggtttcaagtaactccagaaagaagttctcttaatgcataacactattttttcctcccaaccaagagaacttggttggcaagagttacggtagcccctgtgaaggatgcttctggaagcgagcaagaactgattatttctggccctaaaagccccactgtgttttatattttacaattctggcataccacagcttaaaataaatgtatagtctcctatgtcaggggtccccaacccttgtgctgcagtatcagtcaatggcctgttaggaaccaggccacatagcaggaggggacggtgggtgagtgaccatcactgcctaagctccgcctcctgtcagataagcagcattagattttcacagaagcacaaaccctattgccaactccacctgcaagggatctaggttgtacgttccttatgagaatctaaccaatgcctgatgatgaggtgggacagtttcatcccaaaaccatcctccccactccaccctggaaaatattgtcttccacgaaaccagtctctggtgccaagaggatggggactgctgtcatatgtgactgcaacaagttgcaatttgcaatgcctttttttttttttttttgagaccgagtctcactctttgcccaggctggagtgcagtggtgtgatctcggctcaatgcaacctctgcctctgaggctcaagcgattctcgtgcctcagcctcccgagtagctgggattacaggtgcccacgaccatgcccagataatttttgtatttttagtagagatagggtttagcagagaccatgttggccaggctggtcttgaactcctgacctcaggtgacccacctgctgcggcctcccaaagtgctgggattacaggcgtgagccactgcacctggtctgcaatgtctttagccagtcatttgcaatatctattaattttagatacgcatgccctttaactcagcaagcgcatttctgggaatttatcctacagataaattcatataattagacaaaaagtccaaggatgaaagagtggcattatctattattcccattttcctgctaagcctatcggggtcttgaaaggtaaatgcaaggccctcccttgcaaaagttggggaaccaggattagaatcccgatctgtttgaagcctaatttactcagagatggcattagcgatgtttgacacatctgaatatgtcagccctattcacagtcctgtcctaacaactcactgcttcatcccttgagcacaaacaagctattcattagcctgtggaagatccttaggtcttcgagttacaagtctcagctctgcccaaaactcgctgggtgatgctaggcaagtcacttgccctctctgggccttgtatttttcagcctggtacagtaaagttctatgcccctcaccttttttttgagacagagtctcactctgttgcccaggctagagaacagtgatgcaatcagggcccacggcagccttgaactcctgggctcaagcaatcctcctgcctcactcaacctcctgaataactaggactacagatgcatgccaccatgcccagctcattttaaaaatttttttgtagagatggtgcctcgctatgttgcccactctggtctcaaactcctgacttcaagccatccccccacctcagcctcccaaattgctgggattacaggtatgacctgccatacctggcctctatggccctttcctagcaactttgatgaggttgttcctccttagcccctgaaaccctgatacaagtcacagatgtccgacctcccctttcagccactgtgagcagcttcttcctctgtccttggatcacatacaaggtttctttcaaattcttgcctgcctttctctaaattcagtctttcctccattgtgtggccagggttaaaagttgaaaggtcaggagtggaaggagaagacctagagagcaaaaaggccatcccttaaagtatgccatcaagaccctaaataagccaggcgcggtggctcacgcctgtaatctgagcactttgggagaccaagccaggcgaatcacttgaggtcagcggttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatcgcaccactgcactccagcctgggcgacagagcaagactctgtctcaaaaacaaacaaacaaaaccctaaacaaatgtaattggaatttgtaacattcccaatccaggtaaggaatggtagcttaatatattaaagattctaatcaccactttcagcccaaatagaaacgaggtttatgagatcaaagggaagaaaattaagagaagcttctcctttaacggccacatagtttaggcttcccggttctgccaaagatgagccatgccatactgagcaaacatcttgaactctctggttgtgtttgctataaataaccatcactgaagcttaccaggggccaggcactgtgctaaacccttcatacacattagctcatcaaatcctcccatgagggtaatctgtgaaactctggagttagaaagacctagatttgtagaatcttcttttccttactggttagctgagctatcttaagcaagttattcagactccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatctctgccctcccacggaaaagtaatgataacaaatccataacagataccttgtacggaataacacatctatttcggacatgataataaaaaaacatggtgtttacaaggcaagcctggcggcttctcggaaaagacccagctagttcacgttctggactctcggcatggcagcccacctagggtcactggtttcagctaggtcaccccctcaatcaggggacaaacagtgccttttattttaaatgtgcaaaaagtcagtttatgttttcttcaaaggacacggtgataaacatttactttgttggaagcatttagtcccaccagaaacctgaccccaacaagtttgtgtccatggtaaagaagaaagatagtggggtcaagggtatgaacttggactcaaactgacccgggaatgggttctaccacttgctggctgtgtgacactttacctctctgagcctcagctgccttgtatactaaacaggcatcataaagcctttcttatgaagttgttgcaaagattaaatgagataaattaagttaaatgttgcaacagcatgtggcactgaagtgttccatcaacggtagctatctcaaagggaaaacatcaatttccttcaaacaaaattctctatcttatttcacaccctgccacctaatgactttcagttcagcgtcaagttccgtctctgaacaattctaaaatagtatcgttgagtaaatcaaagaaacaaaaaactatgcaaagcagtttattaatagcctgcattctttttgccaaaccccggacggacagttcaccatttaatctctcagttcttcatactgcaactaaacactcccaccttgggtttctaaatattttcttttacttcttgacaagcatggctttggatggtaccttttctcaagtggcaaaatccctaccagaccctgtgctggaagaaaacttacaacaggcagtagccacactttctctcgttttacccatttggttgggcacgagagtggcattgacacaggtggctctgcgggaaattctagtgtaatcttacctaacgcacctgcagatcgtggaagcaaatggagactttggagcccacctgggtatctgggggccctttggggtcaacctgggtgagttgttttttttttttttaatttggagaagaggaaaaagtgggctgtaacaaactagatcacaaccagccttatctcccaggggttctcaacatagaagaacctcccctaaactgattaaaaaaaaaaaacaacaacactcctttctgctaagcctatgcccatgtgtttttaactgatttaatgcattatcaacacaactgtgcaatacggtcaaatccacaaggagcctcactttgcccttctgtgtgatagcaagtgacttttcagtgaagttcagctgtaaattttttggtgcctagaataaaagtgagatgccttgattgtctgcaccggacctctgagatttccaagggagcatatctcctggattagcctcttaacaagaatcactcgggactaatttttttttttttaaggcagtttttctggggattctagagttgggaaatggagttgggtccaggcattgatatcgttaataagcacccccaaaatggtacttctcactggcaatcttaagaaatgctgtttggggaaagtctaggataatctaagacgataaggcagagagagatccaaatcacaactctgcccccaccatggcccttacgaggttgacaacagggacccctaagtgcaccccagcccctatagaataccctataggacttttaacacccccctgccctgcaatctgcccccagaatgacaactactacttacagatctccaactggggggactagtggagaggaaactggatggcgagctcggatctgacgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaagagggccggctgtgcagcgtgaagggtagggaaaggggatttcttgaactttgcaaagtgcaagacaggaggcccccacccttgctgggaaccgtgcaggaaggggaagtttttacttttcccaacttgccatctccacctccacccacatcaccacgaccaaaatacaaataaaaattaaaaataagcccactgtgattatttcagctgtccccctcccctgtgcgccactcgccagctgcgtgaccttgggcaagtcacttcacttctctgagacttggtgtccatagctacaaaatgggggaaggcggtggcggtgataattacgttatttacaagatgcaagtgtcaagatccaaggagaaagtgggtgtgcccccagagtctgcgagttcccttcaacaacttcccttccccaaggattcctcgcctaaaattgcattccctgtctctctccatcacaggctctctcgctctgtctctgccactgtctctgcatgtctgtcactctgatcattgctgtctctcgctctatcttttgtctctgtccctctcgcttctctagatctgtcgatgtatctgtctctccctcctgtctcactttgtctctggtctctgtgtctcttgctctccatctctcccgcgtgtctcactcctatctctgcgctttctctctctctcttccccaggctctccgtcttctccccgtccctccctccccgctcctgtccacgcacgcacacacaggccataaaaggaagtcgaggcggtgggctggccccgcgccaggccggggacccgcgggcagcccgggcgctccgctccccgcgcggcaccagctcctccgaggttcccgggccgggccgggccgggccggtccccctccccgggagcggcgggagcggcgggcgggagacaacccaaaaagggcaggcgcggactccttcctgcaggaattcccagcgccgcataccagctctgggctgccggctccccctgactaaatatggtgccgagtggccttcctgctccccggcgtcgggggagggggcccttcacgcagccaccggccgccgttgccccgcggggctagatggggacccctctgcttggggaaggcccggaagggggcagcccccagtcccacgtgggtttctgctgcttcaggctagaggatttggagagagggttaaagttgggcagacccctcctgggttctgtacttgacgcaggcccttagtctacaaccactcctcttgcaaccaggtggaggggctgggggccgggggtgcggggggtggctttattaatacccccattttgcaggtgagaaaattgagtccctgcaggggtaaagggatttgaccaagctctcactgggacagtcattgattggtgctggcactggaacctttctgatgacaccattcacttccagagaggagacattaaagggaaatgcccaggcaaactggccttgaggcccagggcgtgtatctgagagtagatgtctggctttgaatctgccagtgctgctttctacctatatgaccatgggcaagtaactttgcctctccatgcctcaatttccctacctgtaagatgggaagaacatcagctacttcctggcctttttgtaagcagtccttgagatgatccatgtaaaatgaacatggtgcaccgcttcatgtgagctgctgttactcgcaacaaacatgaaaccaactagagttgcaccaggcctccgggatataaagagaggcctcttcccctgcaggctcccaggcccatctggagagctctgcatctcagacccttttgggtccttcttcatccttccaacatcaagcttacctggttttcaccctggaaactcctgagcctggccctcaccctgcaatgggcctagatcagagagtcaagaacagcctgcatttagctggctggggaagtgaggggtaaagctctgcggaaaatgatgaatgagctgctccgcacaggcttttaacatctacgctgtaaaaggagtggaaatcgtccctgcatcagcacagaaatgatgtggagcagagaagtaacggaagggggaaaattgaagtcaatcatccgcttcccatcctggaaagggaaggccatcggaatctagcttgctggcctcgaagtaaaaactggcattaatactagaggcatgaacactgtatttccaaagggttccattcgattctttaaataacttgttggtaacttttaaaagagaataattataatgtgattaacaactggagactgtaacactcaattttacttcattctctcacctaccccttatataacaaccctttattaaaaattaaagtaggcagccgggcacggtggctcttgcctgtaatcccagcactttgggaggccaaagtaggcggatcacttgaagtcagaagttcaagaccagcctagccaacatggtgaaacccccatttctactaaaaatataaaaattagctgggcatggtggtgcacacctgtggtcccagctacttgggaggctgaggcaggataattgcttgaacccaggaggcagaggttgcagtgagctgagattgtgtcactgcactccagcctgggagcctggatgacagagcaagactccaactcaaaaaaaaaaaaaaaaagcaaaactaaagtggccaaggccaggcatggtggctcacaactgtaatcctagcactttgggaggccaaagcaggaggattgcttgagctcaggagtttgagaccagcctgggcaacatagcaagaccctgtctctacaaaaaataaaaagttagccatgtgtggtggtgggtacctgtaatcccagctccttgggaggctgaggtgggaagatcacttgagcctgggaggcagaggttgcagtgagctgagactctgtcactgtactccagcctgggtggcagagtgagaccctgtcttgaaaaaaaaaattttttttaagtagccagcctgggcaacatggtgagatgcaatctcaataaataaataaataataaatagcagctgggcgtagtgtagcctgaagttccagctactagggaggctgaggtaggaggatctcttgagcttggaaggttgagactacagtgaactatgattgcaccactgcactctagcctgggcgacagagcaagatgttgtctctaaaaaataaggtacatactttaattccctccctacccccattttattgttgagaatctaggtttggaggggttaaataacacagcagtggtggaacaggaattccaaccccagtctttctgacacaggccatagtagacagcagtctgaggttttaaacccagatctcttaagcaccaaccaagcacctttgggattgtcagtaaacctctctgagcgcattttctcaaggaaaaacaaagatgatcagattctttgcctcaagtacctttctgattgttaaatatgacagcacatgtgaaggcctttatgaaccatctccgacctctctagtaccctctggaagcaggcagggacagtatgttcacttaagagtcattcaatagatatgtgtccaatgcatgaagttccgatgtttgaatcttcagaagtgcattgttatcattcgatcagatgcctctgtttcatttctcatggctcaaaaggtcagttcttttaagatggaggaggcaatagtctctttttaaaatgtcactttgactgagtgctgtcaagtaattttccttggcatatctttttctgtgaccggctgtttaatgggagtttccacgaatccatgaaacaagacagccaaggggaaatttctctcttatagtctttttttgctgttggcttaaaaaagccccaaagtggctgggcatgcctgtaatcctagcactttgagaggctgcagcggaaggatcgcttgagcccaggagttcaagaacagcctaggtaacatagcaagatccctgtctctacaaaataataataataataataataataataataataataataataataattagtcgagcacagcagtgtgtgcctgtagtcccaactagagagtgaagtaggaggattgtttgagccccagagtttgaggctgcagtgaactgtgatcgtaccagtgcactccagcctgggcaacagagcaagaccctgtctcaaaaaaacaaaacaaaacaaaaccatgaagtgtgatcccctccaatttttagtaacatcgaagattgggtctgagcatggcttactcctgcatgtgcctcaagatttaatattttttggccgggcacagtggctcacacctgtaatcccagcactttgggaggccaaggtggagggaacacttgaggtcaggagttcgagaccagcctggccaacatggtaaaaccctatcactactaaaaatacaaaaactagtcgggtgtggttgtgcacgcctgtagtcccagctacttgggaggctgagacaggagaatcccttgaacctgggaggtggaggttgcagtgagccaagatcacaccattgcactctagcctaggctagagagagaggctccatctcaaaaaaaaaaaaaagaagatttaataattttaaagtgttatcagccttgatctacttgactcatatagagtcaggtagatctggcccaagatctgtgaataaaggaacatcgttcctgaccacaagcagggccatgctccaactcttgcacaaaagcacttttgtttcactcatggtggcccccatgatggacctcacacttctcccgatactagactgcattgcatagtaacctgcaatgctctttccttcatcatcagtttccaattctgatgtcacgatttggttcatgacattcctgatagattctctatgtctatcaggaagggtcctaaaactctcaataaaagtagttctacagttttttaaaaatgaaacacacagggcacggttgctcacgcctgtaatcccagcactttgggaggctgaggcaggtggatctcctgaggtcaggagttcgagaccagcctggccaacatggtgaaaccccatctgtactaaaagcacaaaaattagccaggcatggtggcgggcgcctgtaatcccagctactcaggaggctgaggtgggagaatcgcttgaacctgagaggcagaggttgcagtgagccaagatcatgccattgcactctagcctgggcgacaaaagtgaaactccgtctcaataaaaaaacaaaaacaaacaaacaaacagaaacaaaaacaaacacgctcttaccatataatccagaaaattcttcttaggatttgcccaaaagagttgaaaacttctgtccatacaaaaccctgcacgcacatgaagtttataacagctttactcactatcgccaaaacttggaagcagccaagatgtccctcagtaggtgaatggatacataacaatggaatattattcagtgctaaaaacaaatgagctatcaaggcatgaaaagacgaaggaaaattacagctgggcattgtggctcatgcctgtaatcccagcactttgggaggtcaaggcagatggatcagctgaggtcaggagttcgagttcagcctggccaacatggtgaaaccctgtctctgctaaaaatacaaaaattaaccaggtgtgatggtggacacctgtaatctgagctactcaggaggctgaagcaggagaatcgcttgaatcagggagatggagtttgctgtgagccgagatcgtaccactgcactccagcctgggtgacagagcgagactctgtctaaaaaaaaaaaaaggcaggaagaaaacttaaatgcttgttactaaatgaaagatgctaatctgaaaaggccacgtactgtacgattccaactatacaacattctggaagagacaggaataggtggagtagagaagattttctagggcagtgacactcctctgcatgatactaaaatggtgaatacatgtcactagacatctgtccaaaaccatggaatgtgcaggcagtccccaacttataatggttaaacttaacgatttttcaactttatgaaggtgggaaaatggtgcattcagtgaaaccgtactttgaataccgacaaaaccatgttttttcactttcaatacagtattcaataaattacatgagatggtcaacactttattataaaataggatttgtgtttgataattttgcccaatggtaggctaatctaagtgacctgaacatgttaagtaggctaggctaagctaagatgctcggtaggtgaggtgtattaaatacattttgggctgggcatggtggctcacatctgtaatcccagtactttgtgaggctaagatgggcagatcacttggattcaggagttcgagaccagcctgggcaacatagtgagatcctgtctctacaaaaaatacaaaaattcaccaggtgtggtggcatgtgcctatagtcccagctattcaggagactgaggcaaaggaccacttgagccttggaggcggaggttgcagtgagcccagatcgcacaactgcactgcagcctgggtgctagagtgagaccctatccaataaataaataaatgcattttgacttattttcaacttgtgatagttttgagatgtaatcccatgagtcaaagagcatctgtacaataccaagagtgaaccctaatgtaactatggactttttgtgataataatgtgtcaaaatagatccacccattggaatacatgtgccactcgatgccggatcttgacagtgggagaagctagacatgcatgggtgcagggggcagtcaggagctctgtgcttccagtccatttagccatgaacctaaaactgctctaaaaaacgagtctacttttataaaagtagttttgttttgttttttttttccagagaatagtctcactctgtcgcccaggctggagtgcaatggcgtgatctcagcgcactgcaacctccgcctcctgggttcaagcgattctcctgcctcagcctccccagtagctgggattacaggcacatgccaccacgcctggctaattttgtattttttgtagaaatagggttttgcgatgtttgccaggctgctctcgaactcctgacctcaggtgatacgcccgccttggcctcccaaagtgccgggattacaggcgtgagccaccatgcccagcctaaaggtagcttttttttttttattttttattttttgagacggaatttcactcgttgcccaggctggagtgcgatggctcgatcttagctcactgcaacccccacctccacagttcaagtgattctcctgtctcagcctcctgagtaactgggattacaggcgcatgccaccgcgcctaattttttaatttttagtagagatggggtttcatcatattggtcaggctggtctcaaactcctgacctcaggtgatccacccgcttcggcctcccaaagtgctgggattacaggcctgagtcaccaagcctggccagcagttttatttcacttttattttaataagattcctgaacaccacacaatcctcgaatcgtggttgttaccaaaaaatcaagtaccaagtggccgggaagcattgtcccaaatgcctttaaaggcatattctcacaaatgttcatctttcatgtacacttggctttaaaagaacacatcaaattttacatcaacataaaggtatgtgagtgatacacaaatgtgttcttgcacatcattataaggctattagtttgttctgtgcaagcatatacactaagcttaaatttatcttcttcaaaagccacctctgctcctgctatgaggttttagatcacccaagttgtacatttcctaaatccctcttcagttcccattcccatcctgtttttgtgtaaatccaagttttctcctaaaacttctggagcatctctagaagataagttctcccgacaattccaagaaacccacgagtaaggtacttaaatataacacatttatgagaagggttggcttgtcctctgtgcttttccttccttcctataaacatgtgcagacggcaggaaagtacccccgcctccacccctcaacagcgaagcttctgaagatcccgacggaaggcatggcagccatctccaatcattcttctgtttttgatgtgtggcttttgatgagagaacagtgatatgaacaccctttgcaccaaagtgacttgcttattttttttattaaatgatacattgaaagtataaaaagttgccgcagtacaaacaaattacagaataatgcatataaaagcgctatggactacacgtgacaattctgcttaacttccatcttgatgattttatatcagtatccaaaattatatactccagcattttttccgaatatagtcttacatgattgcaattcctgaggtaaactaagtgtccactgccaacatccttggacgaaaaccaagtcccccgggagaattcagatatttatattcacacatacaatacaacggaattcatcaatgtaatcagatattgcagatttaaaaatggaaaatggactcttgcaatacttctgcatccatatataattttaccagcagggcctcccaaaatgttgtgtaagtatagtttaaatggatttcattaataagtttctgcatttagataaaaattcttggctaatctgtaagaagtgaacactgactagcattgccaaacagaaaatcaaaagtttcaacaatttgcaaagcagcacagaattgacaccctaaagaggatgccaattttgctaactacagctcttaccactcttctccatggaaaacctttaagctaaatgttgtcagtgtttaggtgtgcaggcaaaatttaattctgaatataccatcgaacttttgccaatcaggagctgtctatcatcatagtcagttgttttcaatgaaatgagcctgtggacactacattaaaaatacttctttaataaatatcgaagtagcgtattagagatagcacatactatttttctatcccaagaataaaaattgatgtttggtaagagtttcggagcccaaacaagtagggggctggccctcttctggctcatctgtgattgcacaaccgagggccacacggagattaaacaatgccatctttgaaaaatccctttctggtatttctcccaaagcctgtctcttcatgcttacttcacattctttatctaataaaataaactctttgttttatttacagcaaaattattacagcaaatttacttctcctctaccttttaattaaatcttccagtaagccaaagtctaaggaaagaaaaagtacattgttgcctattgaaaaggtaatacaaagccctttcatttccttacaaactttaagggcctttataatacttcctaaatggctgggctcagtggctcacacctgtaatcccagcgctttgggaggctggggcacacagatcacctgaggtcaggagttcaagaccagcctggccagcatggtgaaaccccatctctactaaaaatacaaaaactactccggtgtggtggcacaggcctgttttcccagctacttgggaggctgaggcaggagaatcacttgaatccgggaggcagagattgcagtgagccgagatcgtgccactgcactccagtctgggtgacagagcgagactccatctcaaaaaaacaaaaaatacttcgtaaaaacaatactttttttttcaagtcaaatccaataagctagatgacaagagttagcttttattcacaaatgtagttaaacatgaggggtgttttgtagaaactccaatttctacaaacattagtggtgcattttggtaacattgggacaataaataagttatttaattaataatacaattttaagacaaaagataccccaaacaaagcattatctgttgactgcctgagaaacatgaagatcttcaatgttagtacttttctgttcctcctttcttaggtggtcatctgaaatgcacagaaaccaatgttaatacttatcccaagtcaaaacacacagataggtagacatagctacaaatatcttaggatgttacatatttaatattctatgagtactttagatggtttaggacaatgaaaaaaacccattattttttaaacactattgaagaaatcagaggccaagcgtggtggctcacgcctgtaatcccagtactttgggaggccgaggtgggtggatcacctgaggtcaagagttatagactagtctggccaacatggtgaaaccccgtgtctcctcaaaatacaaaaattacccgggcgtggtggcaggcgcctgtaatcccagctactcgggaggctgaggcaggagaattgcttgaacctgggaggcagaagttgcagtgagccaagatcgtgccatttcactccagcctgggcaacaagagtgaaactcggtctcaaaaaaaaaaaaaaaaaaaagaaagaaatcagaaatgtctggcattagggactctaattattcaaaagagtttcttgactttttttttgagtagagtacaacctgcagtaaacccatgcataagtagttacaaacctctctcttacatgtaaggaatgaaatttgcaagaaaggacaaggtgttcaatcagcattttgagggttgccaaagctcttcaattacaacacaatgaaaaccacttcaaatagatcacctgaggtcaggagatagagaccctgtctctactaaaaatataaaaattagccaggcgtggtggcgggcacctacaatcccagctacttgggaggctgagggcaggagaatcgcttgaactcagaagtggaggttgcagtgagccgagatcgtgccactgcactccagcctgggcgacagagcaagactcttgtctcgagaagaaaaaaaaagaacctagagacttaatatcctaatgcaacaaaaatgtaatgcaaaaactagattcttgagaatatatgaaccccaaacactttctacaactgataaaacatctttcttgcaacaactttgataataggaaaaaatatatacataaatttagataagctgctagaaaatgcaattttatcactgggttttctaattctacaatgtgattatacacacgctttattagttctcagctgcttattctcagtgccaatactactttaagggtctggaaaacagatggaaatctctctccctttattttaggtaactttgctggacagaaaaaaaattaacaatttcctcagaaggtaacaattttaggtcttctagaaaagtgttataaaaaatgaagtctactatgcttgatagatgtgcaataaagttaagctgatgactgtccctattataaaaatctggtctttcatttacaataaaaatcttcgccaggaatgtagtcccagctgtagtcccagctacttgggaggctgaggtgggaggatcacctgggcctgtgaggtcaaggctgcagagagccatgattgtgtcactgcactccagcctgggagacagagtgagaccctatctcttaaaaacaaaaaaaaaaagaaaaaaaatgtgtgtgtgtgtatatatatataaagttgaatagcaaaaactactttgccttcaagattacaagcactaacagcagcagtacaaatgcactggctgtcatttcaaaggtgggtgtgcctacataaaccctcttcattttttttcagcactgaaaacttggatgagagaagcactttttcatcttggcatgctttggacttacttctttctttccttttttttttttttttttgagacagagtctcgctctgtcgcccaggctggagtgtagtggcgcaatctcggctcactgcaacctccacctcctgggttcaagcgattttcctgcctcggcctcccgagtagctgggactacaggcgtacaccaccacgtccagctaatttttgtattttcagtagagacagggtttcaccatgttggctaggctggtctcgaactcctgacctcaagtgatctgcccacctaggcctcccaaggtgctgggattacaggggtgagctgccgtggcctggcctgaacttattttcaagtaaaagccaatttagtttcagggtttgatatttctgttgaatgagcttctgtggagacaaggtgctgtgatgtagaataaggattttagtatcttcataaccttttcaatgctgtcaaataagagttacggagacagtaagctagagttgaggaagtaaatggaaagcttaagtgtgttactgaaacatgatgcagttctggctgacaactttcaaggcactacacaaagaggttgtgtcaataaaatttttgatgaccaagaaaataatttgcaaaatcactgttcttccccgattcattcagcagtcatcctcatttctgagctgtctgcagagctttccacagaacaggcacccaaggtggctttactgacttgaactcgattctgatgttcctggcactttagtggtgtacaggtcgtgtgtctaggtgtctctttccctccctccctccataaatacctttctctctatggtgtatgcgtaatctaccgctttcatctcagaagaacagaaattggttaggaaatagtgttccttataactttcttactagtcatgagccgtgagtattaacaaggctgattatgaaacttacaaaccagaaagttatttctcaagcggttatttttctttatgggactgatagtatcaatgacttggggttgctgtgttaagaagtgttaaggtgtacaatatccactggtgacaactgaactcagaaactcatattgtcatatattcttggtaagtgtatagactgataaagcctttttggaggggaattagacaatatctactacatttttaaatatgcatatcctttgaaccaacaactctactttaggcatccacacaagagaaacgtgtagacaaagatacaatgttacatcacaatactgtaatgtgtggacaaagatacaatgttacatcacaataccgtaaaagcaaaatatttaaaactaaataagagtgattataaggtgggagagtagcctgggcaacaggacaagaccctgactgcaaaaaattaaaaaataagcgaggtgcagtggtgcacccctatagtcccggctacttgggatgctgatgtggaaagactgatcccaggagtttgaggctacagtgagctatgattgtgccactgcactccaacctggatgacagagtaagacctcatctctaaaattaaaaaaaggatgattgtaataatactctggaatatgaaacaaagttaaaaacgagatctacacgtatcaacaagtaaaaaaaagcaaattgcaggataacgtgcaccataacaatgtatatatatttaaatacacagaaatgagtcccgaaggggctgggcatggccagatgcagtggctcacacctgtaatcccagcactttgggaggccaaggggggtggattgcctgaggtcatgagttggagaccagcctggccaacacagtgaacctcatctctactaaaaatacaaaaattaggcgggtgtggtagcacatgcctgcagccccagctacttgggaggcaggagaatcacttgaacctgggaggcggaggttgcagtgaggtgagattgtgccattgcactccagcctgggtgacagagtgacagtccatctaaaatttaaataataataataaaataaaataaaataaataaaataaaatagaaatgagtcccaaagaataccctgcaaactgctaacagggacaccttctataaaaagggagaagaattgaggagttagggagaggcaagaaggaagaaaggaaagttaaagggaactttttactatttaaaaaatttagagatttactcatgtacttgcactattaatgttttattttgctcgttaagtacttgccaattagtaggcagtaatgtcagttccttaccaatccctaaaaagagaatttggaaaacttctccataatctatatgtggaaaggtatacgggaacagcaatcaaatgtgctgattctgctactaattatctgctacaggtcttagttgagttacttaacctcttagtattggaaccttcttaaagttttctcaactatgaaataagtagatgggaatgacttattttccaacgttccatccagttcagcattctaatatatatagaaagatatctcctagtgcagtcagaaaccacctccaaaataggttatcctgattcactgtttactttcagacctcaagagacaccaagcatctaacacggtcactactggtcatagcagtttaggaaactacaaaggcaatccacattttaggcgtttcctaaaagtttcctaaaagttcgtgtcaacattcaagatttacatttgttctgataattggcagcctaaaccccacctttaactgtccttaaaaattgaccagctcttggttgggcgcggtggctcaagcctgtaatcccagcactttgggaggccaaggtgggcggatcatgaggtcaggagatcaagaccatcctggctaacacagggaaaccctgtctccactaaagatacaaaaaattagccgagtgtggtgatgggcgcctgtagtcccagctacttgggaggctgaggcaggggaatggcatgaacccaggaggcagagcttacagtgagacgagatcacaccactacactctagcctgggcgacagagcgagactctgtctcaaaaaaaaaaaaaaattgatcagctctctaccacaactgaaaacactgagctataacccactcaattcaaatggtgaaaatgggatcccattgctgggataatcaaaataagtcagggccaggtacaggctcgtgcctgtaacccccacactctgagaggctgaggtgggaaatcacttaagaccgagttcaagaccagcctagtgaacacggttgagacttccatgtccacaaaaattaaaaaattagctgggtgtggtgcctgaagtcctagctacttgggaagctgaggcaagaaggtgagaggattgcttgagcccggcagttcaaggttacggtgagctataatagcaccactgcactctagtcaggcgacagagtgactagaaaaaatacataaaaatttatgtatttttatgtctcaaaaaaatacataaaaatttatgtatttttatgtctcaaaaaaatacataaaaatttaaaagctaccaaaagctcatttaaaaaacaggcaatctgaaagaaatgtgggcgattctcctaacaatctgtaacttgtaggtaacttccactgtaacataaacagtatcctaaaaatgcaaatgacttctctatctgtatttagcaatcttaccttttattttgcagtcatggagaggaaaaaaaataatcacttgataaaaagctatttattcagtataccaaggatctaagctgctccaaatacttacaatttacatgaaaattggagttttcagtatttttttgtttttttttaaatttaattaatataattttttaattaaaaaaatagagatggggtttcaccatgtcacttaggctagtctcaaactcctggcctcaagcgatccacctgcctcggcctcccaaactgctgggattacaggcatgagccattgtgcctagcccagagttttaaatacttctataaagaaattacatctaagaattctgcccagttatgcctcccacccttccctgtccaagattctttacaaaaagcattctgtttcttggagtaacataggctagacatattagatataagcagaattaaactatgactcaaaagctcagtaaagactccaaaagaaaaatatataggaagaaaacatatttgctgacagctaaatgatgaatcttggaaaactcatacccattggctttcttctactaggttgtctgccaagacttgggtctgaaggctgaagtgaaggccctttcagaaatgcattctggatgccatccttagttccacgcaagaaatgggctaaaatcccatataaaagaggtctatagcaggaagaaaacaaaacaaaaccaaaagctaataaatctgcataaacgggaaaagcttaaaacatttattctttaaaaggtaacctctgacatcaaaaagaccaagtgattcactagactttaaaaagcggcatgattatccaaaatgcaaattgttcatacttttaaatttaagagtaccacttaatttcatgacaattttaaaacccagagaaaacatgttaacaacttaaacctcatctacactgaaatatcatttctatcaatccacaggaatctcttttaaactccaaagtccagtagagtatttcccaatacctaaccccatctaatacacaacaggtattcaataaacacctcttgattaataagtccttgccctgaaaaagtcttaggtcctgagagccaggtgacctgagttcaaattctggctttgccatttgctagctgtgggactctgtgtaagattcttaacctctccagcctcataaatgtttcttcctttataaattaggataagcaccgtccctcccttatagggctgttatgcactaaatgagttaataaatgtcaagtgttttttactgtgcctggcacatatgaaatggtatataaatgttagctcctgtgtagctaacatttatttagattaatatttacattacctattattttaaaatcttctttatagtttacagaacgtatacctcttctcatctaatcctcatcgtgtaatgtcaagatcatcaactgcaatttataaaggagaaaaccacagccaggagatttgctagagattcccccagatagtaaacaaagtttacacttgaaccccaaatcccatattgttttccttacagtgtgctgcctgggaatttatattagtactcttgcatcaaggaaagctgctctgctgacaatcaagagtggtacaatggaaatgttttcctttgtttccaatctcaaatttgaaaacacaattaaaaggatttaatctttatttttaatttttgtgggtacatagtaggtgtatatatttgtggggaggatttattttttgagatatgtatctatttactagctggtataatggtttacagtacgacgctcccttccaaagatggaatctcattgccctctgagtgtgagctgaactcacttctaactggcacaaagctgacttcagaggccacgtggtaatggccctgcagcttcctccttgctttctctcttggattgctgcctttgggagaagtcagatgcctcaggacacttcagcagccctggaaagttacatgcagtaaggaattgaggccgcctgtcaatatcattatgagtttggaagcagatagttcagccacattcaaggcttccgactacaaccctggctggcatcttgactccaacctcaagggggagcctgagctagacttacgtgactaagccaatcccaaatccccgaatattccacaaataatctatgttgttgttctaagctaccaaattctggaataatatcacactaatttttccatgccacagggaaaccaggaaagtaagtttctttatttaataagatgccgcaactcttatgaaagcgtcacctagtaatataaaacaggtctctttgtttactttaatcttccccaaagtgttaactggttcaagatgatttttaaatgttaaaagttttattttttaaataaatattcaaaaaaatgtacttgtgattaaaattttgggttggacatgggggctcaggcctgtaatcccaggactttggggggccagcctggcctcaaacaggagtttgagacagcctgaacaacatagcgagtcccctagctctacagcaattttattttaaattagccacagaaggtaatatgcacctgtggtcccagctacttgggaggctgaggtgagaggatcgcttgagtgcagaagggagaggcaacttgcaaattcatggattaaggtttatcttttaaaataagtttcaaaaagataaagaaaagtgcggcctcacaataacttgcctgtaattctgaaatgcaaaattctgaaaactggattctcttcatatatctggcaaaaaatcatcagatggcaagggttgacctaacaaggctattaacaaggctattacagactttatcttactttgtgtgaaaacattaatgtgctgggtgtggtggctcaagcctgtaatcccagcactttgggaggccaaggcaggaggatcacctgaggtcgggagttcaagaccagcctgaccaacatggagaaaccccgtatctactaaaaatacaaaattagccgggtgtggtggcatgctcctgtaatcccagctactcaggaggctgaggcagaagagtcacttgaacccaagaggcagaggttgcagtgagctgagatcatgtcattgcactcaaaaaaaaaaaaaaagagaaagaaaatattaatgtgattgtggaatactactttaggactccctggcacatacatgtagtatttggtagatgtaccatattactttttttttttttttaaagaattgaagtcttgggccgatggctcacacctgtaatcctagcactttgggaggccgaggcaggaggatcatgaggtcaggagatcgagaccatcctggctaacacggtgaaaccgtctctactaaaaatacaaaaaattagccaggcgtggtggcatgcgtctatagtcccagctacttgggaggctgaggcaggagaatcgcttgaacctgggaggcggcagttgccgtgagccgagatcacgccactgcactccagcctggacgacagagtgagactctgtctcgaaaaaaaaaaaaagaactctcgctgtgtggcccacactggagtgcagcagcaagatcatggctcactgcagcctcaatctcctggatttaagtaatcttcttgcctcaccctcctaagtagctaggactacaggcatgtcattttaaaacccgacagcatttggattttcaaacatgtatctggcctcagtggtttcagatgcagcactgcagatctgtaagtaaataatatgagtaatatgtgactatggcaaactctgtgaatgccaatcactgaagtgtgagaaacaagggcttaaagaagttacctaacttttaaaaaataaagccgttttagcaacttttttttttgcttcctcatcctctctcaaacttacttttttttttttttttggaaacggagtctcgcttctgtcgcccaggctgagtgcagtggcacgatctcggctcactgcaagctccacctccccgtttgacgcccattttcctgcctcggcctcccaagtagctgggactacaggcatccgccaccttgcccggctaattttttgtatgtttagcagagacggggtttcaccgtgttagccaggatggtctccatttcctaacctcgtgatctgcccgcctcggcctcccaaagtgctgagattacaggcgtgagccaatgcgcccggccttcttttttaaaaaaatatcaaacatttcacgaatttgcgtgtcatccctttgccggggccatgctaatctctgtaccgctccaattttagtttatgtgctgttaaagtgagcacaaacttcttaatactttcatctgaagtaggtatctcaaaagctaccaagaagccagtaatagtcattgcttatttccatcaactgctaaatgtaaaatgatgtcttgtattaaatgatgtaataactcactgctcatcctaagtcacgcttagattcccccaattatttttcccactgttctcaattatacaatttttatacttttcaaaacacttgttaccaggtgcagtggctcatgcctgtaatcccaacactttggaaggccaaggtaggtggataacttgagctgaggaattggagaccagcctggctaacatggtaaaacaccatttctaaaaaaaatacaaaaattggccaggcatgatggtgcatgccagcgtatgcctgtaattccagctacatgggaggctgaggtgggagaatcgcttgagcccaggagttcgaggctgcagtgagccatgatcaagccgctgcactctagagacctgggcaacagagtgaaaccctgccttgaaaaaacaaacaaaaaaacctcacagcactttgggaggtggaggtgggcagatcacttgaggccaggagttcgagaccggcctggccaacatggtgaaaccccatctctacaaaaaaatatgaaaaaaaattagctgggcatggtggtgcacacctgtaatcccagctactcaggaggctgaggcagaatcagttgaacccaggaggagattgcggtgagctgagatggggccactgcactccagcatgggcgacagagcgagaccctatctcacaaaaaggaaaaaagaaaaaaaaaagaaacaagggaagatgagaggaagagaaagaggaaaatgccataaaggagttactatctgaacagggccaacagaaaggaaagatgctccaatagaagttaagatgctccaatagaagagggagaaaggtgatgtagggcttctaggataagggaatggtttacaaggcaaagcagcataaagttgcaaagtgtcttccaggcataatcagaaatcaggtgtgagcagatagaacaacagacgggtagaaagaggtgtaaagtgctacgctaagcaacagggacttcactatacacacaatgacaaaggtagtatatgatcctggaacattaattttacacaaggatttgtgggagagttagatttaactggaatgtcatttaaaacatttatatagtaaagcaaacaactttcagaacttttttttttttttttgagacagggtctgattctgtcacctaggctagagtgcagtggtgtgatcttggctcactgcaacctccgctgcccaggttaaagcgattctcatgcctgagcctccctagcagctgggactacaggcacacgccaccatgccttgctaatctttttgttatttttagtagagatggggtttcgccatgttgaccaggctggtctcaaactcctgacctcaggtgatccacttgcctcagcctctgaagtgctgggactacaggcatgagccaccacgtctggctagagatggggtttccccatgttgtccaggctagtcttgaactcctgagctcaagtgatccttccacttcagccttccaaagtgctggcattacaggcacgagatacctcacttggccttaagaacttttaggatgagaaaacgtaaggcttcaaagaaagttctagatttaaaaaaaggctgctttaagctatgttctcaggtctcctatgtacttttttttttttttttggctatacagggactctccagaaaaagtttaagaaacactgaaatagaaaaaaactaagaaaactagaaagtggtcatcctccttttcaagagcatagttggtgagaggaggtacacagagggcaaaggacagagtaatagtaacgaaagcagtgggctgattcagtaatcttggtagaaaaaggtattcgagcagaagcttggggttggaagttcatagtttttgtttttgtttttgtttttgttttaggagaggagagatctgagtacattcctaagttggagtgaaggaagagttaaatatgaagaaaacaactgacaaggcaaagtctcagaggccaggcatggagggctcacacctgcaaccctagcactttgggaggccaaggcaggaagatcacttgaggtcaggagttcgagaccagcctgggcaaaaaagcgaggccttgcctctacaaaaataatttgaaaatacaaataaaagttgaaattataaattaaaaaacaaacaaagccttagaaggacaaaggatcaagaagtcaaaaggagctaactccagaaagaagatgctgagtcactctgaagccatgtaattgtagcttcagcaaacacagatctcatctgacttattcactgctgcacaccctggatttaggacaatgcttgacacacactagatctgaataaatacttgaattaaaatgaagtaaaaccaccatggtgcaattatgactcaatacaatatgtggaaacttctttaaaaaaatgtcttacattgtattatcctttgattcttcaaatgcatttagttcatggatgagaaactgtctgtccaacggaactacaggttgaccagattctgggagaaataaattcatgagaacactcagtctattaaactaaaaagcaaataagattttgaaaagaatcacatttaccagacatacactttttagattttggaagaatgatgacaacacacaccaagacagatcaaattgcctgtgattttatgactttcaaaatatctcttttgttaaatgcatgtcttaatacagtttaacataaattcactttttaaattccccagtgtttggttggaaaaataccatttctatatccaaattataatactaaattttggaagtctgtttatcaataacttatttttgaaaagaatatccacttggtgacaatacttataaataaaaattaaagttaacctgaagtgtggggcagctggaactttcacactttgctggtgggaaagcacaatggtacaggcactttggaaaacagttgagcagttttcttataaaggtgagcgtgcacttaaccacacaacccagcaatctcactcttagctttctacccaagattaatgaaaacttatgttctcacaaaaacctgtatgtaaatgtttatggcagcttgattcctaactgctaaaactagaaacaactcaatgcccatcaactggtcatagatgagcaaactagcacagccacacaatagaacagtgttcaaaggaaaaacaaacatggctgaatcttgaatgtattacactaagtgaaaaaaggcagactcaaaaggctacatcatgtacggttccatctacagcaagggtccccaacccccgagccacagattagaaactgggccacacagcaggaggtgaggagtgggcaagcaagtgagggaagcttgatctgtgtttacagctgctgcccatcactagcatcactgcctgagctcagcctcctgttggcagaattagattctcatagaagcgtgaaccctattgtgaactgcacatgcgagggatctgggctgtgcactccttatgagaatctaaggcctgatgatctctcactgcctcccatcacccccagatgggaccatctagttgcaggaaaacaggcttagggctcccactgattctacattatggtgagttataattatttcattatatattacaacacaatcatagaaataaaatgcacaataaatggagtatgcttgaatcatcccgaaccatcctcccaggtccatggaaaaattgtcttccatgaaaccagtccctggtgccaaaaaggctggtgatatcttgattgtgatctggtagtaattacacaactgcaggcatttgactaaagtacagaactgtacagtttaaaaggtaaattttattgtatgtaaattatatcccagttttttaaaaaaagccaaaccatttaatatgaaaacttgactactgtcactatatttcattctagtgaatcccaagtccccactattttcataatttcttcttttctgggtgtaactggtatcatacagccatctataacaaacaaaggaaagcagagatgctgatatcaaagatccttaaaccataaaaatcatgagtctttatgtagttcagacgtatgtttaatattaaataaaggatctgtaacgaaaaattctaacttcacaaagaattcattctctcttgcaaaatctacttcctggcctcgcttctttgctgaggcatgaagtagtcaaagcagagatggaacctgaaacgagggaatccgatgacacacattcagggtgcctcagaccaacccccagctgcatcccccaccccaccaagtccaggggtaaccaggattctgacttatttatatccatccagtctctcctcacttttttgaaagaagacatttaaaagtcagcagaagatattaaaaatattctcaccactcaataactgttacacttgaagagcaaatttatttctcaagaaataaaattcaacagataaagggaatttatctttatctccccacccccaacccccaatatcattctctgcctcctatcactaggatgagtttggagtttcccgctgctagagtctggatatttgtctccgcccaaatctcatgttgcaacgcactccccagtgttggaagtgggacctggcgggagttgtttgggtcatgggggtggatccctcatggcctggtgctgtccttaccacagtgagtgggttctcatgagaacaggtcatttataagtgtgtggcactaaccttccccacccttggcccctgccttcaccatgtaacgtgcttgctgcagtgagcaaaagctccctgaggcctcccagaagctaagcagatgccagtgccatgcttgtacagtctgcagaaccgtgagccaagtaaacctcttttcttcaaccgggtgcggtggctcacgcctgtaatcccaacattttgggaggccgaggagggcggatcacgaggtcaggagactgagaccatcctggctaacggtgaaaccctgtctctactaaaaatacaaaaaattagctgggcatggcctgtagtcccagctacttgggaggctgaggcaggagaatcacttgaacccaggaggtagacgttgcagtgagccgagatcaatccacactccagcctgggtgacagagcaagactctgtctcaaaacaaacaaacaaacaaacaaacatacaaaaaaacctcttctcttcataaattacccagtctcaggtgtttatttatagcaatccaaaaacaacctaatataccagcctagtcctttataaataccatgcttttagatacatacatttgtaaatgtacctaagcactacatagtagtaatatttcaaagttttatctccattatatctatctatctatctatctatctatctatctatctatctatctatctagatacacacacacacacacacaaatagacatatatctacatatctatatatagacagggacagttttttttcttttaagagacaggagttggaccagcctgtccaatatagtgaaaccccgtctctactaaaaaatacaaaaattcgccgggcctggcagcacacacctgtagttccaggtactcgggaggctgaggcaggagaactgcttgaacccaggaggcggaggatgcagtgagctgagatcacaatagagtgagactccgtctcaaaaaaaaagaaagaaaaaaaagacaggggttgggtgcagtggctcatgcctgtaatcccagcatttggggagtgtgagataggtggatcacctgagcccaggagttcaataccaggctgggcaacatagtgagagctcatctctataaataataaaaaaatttagctgggcatggaggcatgcacctgtggtcccagctactcaggagactgacgcaggaagactgcttgagcccaggaggtgaaagttgcaataagccatgatcgcaccactgcagtccagcctttgcaacagagtgagattctgtctctggaaaaagaaaaaagagacagggtctctctctgttgcccagactggagtgcagtgatgcgatcatggctcactaaagcccagagcacatgggctcacatgatcaccccctccccgacccctgctcagcctcagctaggacaacagacacgtgccaccatgcatggctaattttaaaaactcttttccagagatggggtctccctgtgttgcccaggctggtcgcgaactcctgggctcaagtaatcttgcctcggcctcccaaagcactgagattacaggtgtgagccacctacccagcctattttttaacaaataatatacttaatcagcgtatatttttaaagcttaatacacaggaaaaaactggtggcaaacaggacaaaacgtcaacaattgtttattctcggttacaggaattatagatgatttttccaagtatatgcctagtttaagtgattatttagttatgtattttctcttgtaagaatctgtttaagctacagaaagaacccatgtgatttttgtgtcccagtcacccagatggcactatctggtaagggaattagatttctaggataaacagtttctgagaattggggaaaggggagaaacagattttatgtgataaataataaccacttacctgctatgaggacagatgctgtatacttatatttgttgaattctaaatactctcgaattaattcattaattagaaggttttcatgagacaatgatggtcggggttcacggtcatcatctagggcattgaaaacttcagctcggatccttgcttttaaatgccctaataccccctttttttccaaggtgtcctttaaaactgttcgatataaaatattaaggcttcagttacagagtaaatttgtcattcttaggcatactttgaaaagaaatgttgaaaaggtaaatggtacaaaaacagctctcaagcagctcttaatctaaacattgtgacaaattattaaacaattacactaccaccagccatgtttatactaaaacatatagttctcatgttgcagtgatttagtcttaatatatttgagcaaattcaagtttattcctacatcatcagcactgtcaggggctgtagtctaatacatattcttttttattttatttattattttttttgagacacagtctcgctctttcacccaggctggagtgcagtggcacgatctcagctcactgcaacctctgcctcccaggttcaagcaattctcctgcctcagcctccagggtagttgggactacaggcacgtgccaccacgcccaactatttcttttttgtatttttagtagagacggggtttcactgtgttggccaggatggtctcaatctcctgacctcgtgatccacccacctcagcctcccaaagtgttgggattacaggtgtcagccaccgtgcccggccaatacataattctttagtgaggggaaaaggcgggggataggattatagttgcttactgagacctgaacttaagccccagtctctcatatattttcaagagtgtctgccactgcacacaggttctgcttgtcactaacaacctctggtctagaaagatgattaaagaaaacaactacattccataaaagaagtctgttgggttactgtgtaaaaaccttgatggcagggcatggtggctcatgcctgtaacccagcactttgggaggctcaggcgggcggatcacgagatcagcaaattgagaccatcttggctaacaaggtgaaatccccctctctactaaaaaaatacaaaaaattagccgggtgtggtggcacgcacctgtagtcccagcaacttgggaggctgaggcacaagaattacttgaacctgggaggtggagggtgcagtgagctgaggtggtgccactgcactctagcctgggcgaaagagtgagactctgtttaaaacaaccaaccaaccaaccaaccaaaaaaaaaaacacaaacctttgataatccacaacgctttagggagtgaaaaggtgttgggtttttcattgttgttattttgaaacaatctcgctctgtcgccaggttggagtgcagtggcacgatctcggctcactgcaatctccaggctccctggttcaagcaattctcctgcctcagcctcccaaatagctgggattacaggtgtgcgataccacgactggctaatttttgtatttttagtagagacagggtttcactatgttggccaggatggtctccatctcctgacctcgtgatccacccgcctcagcctcccaaagtactgggattacaggcatgagccactgcgcccactggcctcgttgttttaaagacaactatgagttaattccttagaacagtaggattctgaaattttaagcctagttagaaatctaccacgtgactgtatcaatgccatcttaaggagtcagggatgtgtatgcagaatggaaatctaacttactgattagccagagtcaccatgacaaagcagttatgatcatgggatttggctgtacatacttagtatagataatggggatcttaggactgaattggcaccatcccttgtagtgatctgcaacttttattttcaaacagttcctactggctaaatgacaacttcagagaatgaacacatctcatccacagagtcaagaacagagcaagagctcagtaggtgtcacctagaaggattataatacattgctgtacactactgggaaatcaatgtagtttaacactgttctgcaccctgccaaaggcaccaagtaagtacatcacaataacaaaaatccataaagagagcccaggagcttatccaagtcagtatggacataagatctttctaagcttcaataaataacgtcaacaataaccctggatcatatgactaaagagatagaatcttcactgacttttgacctttctttcccctcatttttaaagcatcccttcaaccttcttgcagataggttaagtacagttatcaccagatcagagtttgtaacaggtccataaaaggaaggtacagccttattgtactcttagaatcataactgaacccctattctctaattccatctttggaaattggatggagagattttgtcactggcaaggatcctgtcccaattactctgtattgcacacaggacagcctcaaactggacagagaaacgagaattagtgacagtggaatgaggaaagctagcatgtctcatcagcacctcagtggtggattaccaacccatgcctcagttgccttctctaaaataatgagctctacctctcagagatagaaccaagtaagaaggaaaaacgtgatcgtgcttaaaaaaggtaaatgcccataaaatgtaaggtaactggctggcaaacaagttttcaccgggtttcttttggaggtccatagcattttacctttccctctattatgcttagaacactgcgccatcaaaacttcttcggaaaggtcttaacctcgcttatatttcaagagtaccttttttattttattttttaatttgtttttttttttgagacaaggtctcattttgttgcccaggctggagtgcagtggcaccactgtagctcattgtcacctctatctcctgggctcaagctatcttcctgtttcagcctgtggggtagctggaactaccacaggccactatgcccggctcttttttttaatttttattttttaaataaagatggggtctcaccatgttggccaggctggtcttaaacttctgggctcaagcgatcctcccaaagtgttaggattacaggcatgagccactgtgcttggcccattccaagtgtacctttaaatcctctgaaaatgtatgcaatattacatgtgatgtgtatttccctgggaacagcatctgtagactcgtgaagtctgttcttgtggacagatgcatgcctgttctgttttatgattgttcaccagccctgtccccaaatacacacttttatacacgtctcctccctaaaatatctaagaattactagtttaaaccctgggttccctgcaaagtggaactggttttattttttggacagcaatcttgctcagtgattaagacctggcgctccagtgcgtcacaactaggttcccatgctgtgtctctttccagtgaaatcactttgagctatttcacttctcagtacctcgtttcccagtctatgaaatgggcatagggttgttacaatcaggtaacacacaggctgagttgagtagtgcctgacacatgaggctcaatgataactattattactattacttgtctggacatttgcttcaaagtaaacagcgtacaaatgtcattaatgactcaaacataactagcttagagtatcttttcctgaaaagacaggagaatggccaggccagcaaactttttgcctctagtttcttctgatgaaaaaggggccaggcgctcacacctgtaatcccagcactttgagggggccaaggcaggaggatagcttgagaccaggagttcgacagtaagaccccgtgtctacaaaaaatacaaaaattagccgggcgtagtgaagagcccctgtattcccacctgctctggaagctgaggtgggaggatagctggagtcccggagttcgaagctgcagtgagctgtgatcgcgctactgcactccagcctgggcgacagagagaccctctctttaaaaaaaaaaaaaaaaagcaaggaggggagggctacttaacaggttgttgtaaggacccaacgagacaaccaagcaaattgtttagggcagtgcctaacccaataggggttgtgggaattgtagtcatcagccctgagtgccaagcctggtccaagtcctccagcccccggcagggtccaagaagatgagccaggggcccaagatgcaggcctgtaggcctcttagatgcctgaagattacgcaactcctcctttagctccaaactggcttaaaactcgccagtgggcaacctcttccccataagagctccccgcgcacgggccaagacagcagccagacgctccccgcaggccctcacaccgaagaatgacgcctgtaaaagccaacccatgtgttccgcgcgctctcctcccatcccatcctttccacaagatgaaggcccgacgcttcccatgtggaggcctccctgctcgcactcaccagccttcaactctgccacagtcgccatttttcaacggccgccagggccgcaccgcggccctgcgcacgcgcagctccgccccactcaccctgcggcgtggtctgtagccaataggcgcacagctctcgccccgcccacttccgcccctctcagtttatgagctctgcggttgagtgggtagtgaatgtcgaccagagactccaccaatcagcgagcgctctcggaaggcccagttgagtgagacggcagggagggcggggactgaggcagtggagagccctgtggggtgctgctggcaccttagtgcttaactttagccagctgagtttttcattgtctctgcagcctcaagtaccaactgctagtagttaccacctattaaccctgcggttctcaaacttgagcatgaatcctcatcacctccaagacttgtttaaacggattgtttgctagtcctccccatagagtttctgattctgtaaatctggggtgaggccctaggatttgcatttctatcgagttcccaggtggtactggtactgctggtcggtctggagatcacacctcgagaaccactgtattaagcacttactgtgacgccttagcgcattatttccttatgatcacgccgtttttacaatgaaggaaacagagtcctccatcgctgaagagacttaaccaaggtcaccagcctgtcctcttccactcgcacttacacagtgcatgtaaggagtccaggagctttttatggaactaactaatgaaggaataagctccaacatcccatggaagtaaaggaaaaggaacaggggaataatgtaccctaaactgagtgtgaggttgcatgattccagttgtaatgccggtgagatccaaacacttggctaaataataaacatcgattagacgtacacctaagagtggccgggcgcggtggctcacgcctgtaatcccagcactttgggaggccgaggcgggcggatcccgaggtcaggagatcgagaccatcctggctaacacggtgaaaccctgtctctactaaaaatacaaaaaattagccgggcgtgctggcgggcgcctgtactcccagctactcgggaggctgaggcaggagaatggcgtgaacccgggaggtggagcttgcagtgagccgagatggcaccactgcactccagcctgggcgacagagtgagactccgtctcaaaaaaaaaaaaaaaaaagtacacctaagagctgccagggcacggtggtttacgcctggaatcccagcactttgggagactgaggtaaggagttcgagaacagcctggccagcctggtgaaaccccctctgtactaaaaaaaaagtacaaaaattagccgggcgtggtagcaggagcctgtaatcccagctacttgggaggctgaggcacaagaatcgcttgaacctgggaggcagaggttgcagtgagatgagatcgcgctactgcactccaacctggacgacagagcgagacaccgcctcaaaaaaaaaaaaaaaaaaaaaccacctaagagcaaggaaacctctttccgaggaacttccagcatacttttggttccatgcctattgtttttaaaactgatacattggccaggtgcggtggctcatccctgtaatcccagcactttgggaggacgaggagggaggattgcttaagctcgggagtttgagatcagcctgggcaatgcaagaccccatctctccaaaataaatacaaaaaattagccgggcatggtggtgcatgcctgtagtcccagttactccagaggccgaggatagaggattgcttgagctcaggagttctagaccaagctgggcaacatgagacgcatttctacaaaaaaaaaaaaaaattagccagatatgatggtgcatgccagctactcgagaggctgaggagagaggatcacttgagcctggacggctgattgtaccactgcactccactctgggcgacagagtgagtccctttctcaaaaaaaaaaaaaaaaaaaaaaaaaaaagaaaagaaaaagagagaaagaaaaattgatatatcacaattatggggagggacgtgatattttgatacacatatacaatgtgtaattatcaagtcaaggcaattgggataaacatcacctcaaacattctttgtgttggaagcattacaagtattctagctattttgaaatatacaatcaataattgttaactattttttttaaagggagggggaacagcctgggcagcatagggagaacctgtctttaaaaacgagcaaacaaggccgggtgcggtggttcacgcttgtaatcccagcactttgggaggcctgaggcaggcagatcacaaggtcaggaattcgagaccagcctggccaacacagtgaaaccccatctctactaaaaatacaaaaattagccgggcgtggtggcagaggcctgtaatcccagctattcgggaggctgaggcaggaaaattgcttgaacccaggaggcagaggttgcagtgagccaggggtgcagaggttgcactccagcctggggaacagagtaagactccgactcaaaacaaaacaaaacaaaacaaaagagcaaacagccaggcacggtggctcacgcttgtaatcccagcactttgggaggccgaggagggcagatcacctgaggtcaggagtttgagaccagcctggccgacatggtgaaaccccatttctaccaaaaatacaaaaattagctgggcatggtggcaggcatctgtaatcccagctactcgggaggctgaggcaggagaatcgtttgaacctgggaggtggaggttgcagtgagccgagatcacgccgctgtgctccagcctgggcgacaagagtgaaactccgtgtcaaaaaaaaccaaaacgaacaaacaaacaaaaaaaccgagcaaacaaaacaaaaaattagcctggcatgtgtccctgtagtccgagctactcgggaggctgaggcaggaggattgcttgagcctaggaggtggaggctacagtgagccatgaccataacactgcatttctagcctggtgacaaggggagatgccttttctttcccttccttccttccttccttccttctttccttccttcctttcctccctcctctctctctccttccttccttcctccccgccctttccctttccttccttccttccctccctccctccctctttctctctttctctttctttctttctttcttttctttctttctttctctctctctttcctctttctctcttactttttcttgagacttaaaaaaaaaggggggccaggcagagtatcttgacctagagtctaggataatgctctttaaactgctggttaaccaaatagtaggttttgaaatctatttattagtagatccccatgagtacattttcagtgaaatggaatgtaacaaatagaaaacatagaagtatggttttctagaactttcctttcaggtacacatgtgtgttctggtacctgttgtatttcttaaagtgatcagccatcagaaaagtttgaaagtgattgtaacctagaggaatctcttcctattccaaactggattaatttttgactggattaatttttgattatgggacacatatctgttctgtaaccttgaaaaggtcctatcttgtttctctactctgtaaaaccacagtgactgaatacctggccagcatttcaagagatttttggggattaactaaattccataggtggtatttttaagtccctcagaaaaagcactcctgtggtgttatgatataggtattgattttcatctccacgattcctggcatctaactcccattcacctcattataatgttgaggcactttaggcctcaggaaacagaatctccctctctgatcttctcctgtccacctctgacctgccccaagcaggactctaatctgactgtgggtcaaaagaccctcattccagaaagggttctgcctgctaccctcaaggaagaaatgctgcacagagagcccaagaaaagtctgagcagacaggctttgctgggtttagatcaggcactttctgtccaatcagatttctttcttttttttttttttttttgagacggagtcttgctctgtcgcccaggctggagtgcagtggtacagtctccgttcactgcaacctctccctcctgggttcaagcgattctcctgtctcaaccacccaagtagctgggattacaggtgtgcaccaccatgcctggctaatttttttttttttccagacagagttccgctcttgttgcccaggttggagtgcaatggcacgatctcggttcacctcaacctctgcttcccgggctcaagcaattctcctgcctcagcctcccaagtagctgggattacaggcatgtacaaccacacctggctaattttgtatttttagtagagatggggtttctccatgttagtcaggctggtgtcgaactcccgacctcaggtgatccgcccacctcggcctcccaaagtgctgggattacaggcgtgagccaccacgtctggcctgtccaatcacatttctacacggtgttcaatcacacctatgtaataaagtgtcccataaaaacccaagagaactgggttgggagaacttctggatagcagaacacgtggaggttgttgaagggtgttgcattcagggaaagcatggaagctccacaccccttcccctatactttgccctatgtgtcacttcatctgtataaacaaaattaagtgtttccctgaattctttgagccactccagcaaattaatggaacccaaaatgggggttgtggaagctccaacttgaaggcggtccatcagaagtttcagaggcccaaacttgcgactggtgtctgaaggaaggcagtcttggggactgagctatcaccctgtgggaaatgacactattttcaggtcgaagatgtcagatttaaactgaaggacacccagctggcgtcagctgcagaactgattgtttgctggccaggcgcaatggctgaagtctgtaatcccagcattttgggaggcagaggtgggtggatcacttgaggtcaagagttccacactagcctggtgacatggtgaaaccttgtctccactaaaaatacaaaaaatagctgggtgtggtggcatgcacctgtaatcccagctactcaagaggctgagccaggagaatcgcttgaacctgggaagcagaggttgcagtgagcagagatcatgctatgggtgacagagtgaggctaaacctaaaaaaaaagattgtatgcttgctggtggggggatttccccacacatttctggggtccacagaagtattctgtgttgattattggtgtgttgatgtgtgagcagagaaaaaacacggtttgagaaagtttatatccaaaaaactcctgaatatgttgatgaggaactcggagagagaggcaaataataatgtgattgaccgattggcagtggtaatcatacagtagctaacattcattatactctctgtatggcaaggactgctctaaaagctttacattaagtattcaccaacaaccctatgagatggatacttacatgcaattgtctcaagtaaaattgtatttaaaaacatactggccaggtgtggtggctcatggctgtcatcccagcactttgggaggctgagacaggcggattgcttgaggccaggaggagttcaagacgagcttggtcaacatagtgaaaccctgtctctactaaaaatacaaaaaattatttgggtgtggtggcacacacctgtaatcccagctacttgggaggctgtggcatgagaatcacttgaacccgggaggcagaggtttcagtgagctgagaatgcgccactgcactccaacctgggcgacagagaaagactctgtctcacaaacaaacaaaaaacatgtactaatgaccaggcacagcagttcatgcctgtaatcccagcactttgagaggctgaagcgagaggatcagttgaagccaggagtttgagaccagccaagccaacaaatcaagaacccatgtctttaaaaaaaaaaaaagtagctgggcatggtggcacatgcctgtattcctagctgctcaggaggctgaggcaggtggattgcttgagtccaggagttcaaggctgtagtgagctatgactgtaccagtggactccagcctgggcagcagagcaagaccccatctctgaaaaaataaatacctttatacatacattaaaaacatgcactgacattgagtaacactgaattgctggggatatgtcgaaacaggcactgccatacatagttggtaggtaggcaatcaacaccaccatccagaaggcagtttgtcaatatctcatcagattttcacaccctttgactcatcaaatctacttctaagaatgtatcttacagatataatcacacctacttacaaaggatataagtataagaatattcattcactgttgatagtagaaaaaactatgcacacctttcagaaaggctaaaataaagactactgacaatactgttggcaaacacacatgtactactggtgggaagacaaagtggtatagtcactttggaaagcagtttggcaattgcttattaagtcataggtacacttggcccagtaatcccaaaactaagtgtttgcccaagtgaagtaaaaacttgtaggccgggcgcggtggctcacgtctgtaatcccagcactttggggggccaaggcgcatggatcatttgaggtcaggagtttgagatcagcctgagcaacatggtgaaaccccgtctctactaaaaatataaaaattagccaggcatgatggagcatgcctataatcccagctacccaggaaaattagccaggtgtggtggagggtgcctgtaatcccagctacccaggaggctgaggcaggagaatcacttgaacccgggcagcagaggttgcagtgagccgagatcgtttcactgcactccagcctgggcaacaagagctaaagtccacctcacacacacaaaaaaaagaacttgtagccaggcacagtggcttatgcctataatccccacagtttatgaggccaaagcgggatgaacgcttgaatctagaagtttgagaccggcctgggcaacatggtgaaaccccatctctacaaaaaaaaaaaaattacaaaaattagacaggcgtgtaggagtgaacatgtagtcccagctactccagaggctaaggtgagaagacctgcagagcctgggaggtccaggttgcagtgagtcgtgatcacaccactgcactccagtctgggcaacatagtgaaactgtgtttcaaaaaaataaaaaatgttctctggtgaggactcggtgattgagggtcagtgttcgatggagacttacttttttttttctttttgagacagtctctgttgcccaggctggaatgcaatagcaccatcatagctcactacagcctcgacctccaggctcaactgatccttcagcctcccgagtagctgggaccacaggcacgtgccgccacgcccagctatttttattttttgtagagatggggtctcaccatgttgctcaagctgatctcaaattcttgggctcaagcaatcctcctgcctcgaactcccaaaggcctggggttgcaggcataaaacaccacacccagccttacttttgtccatagacttattttaatttattaattaatttatttatttgagactgagtcttgctctattgcccaggctggagtgcagtggcacgatctgggctcactgcaacctccgcctcccaggttcaagcaattctagtgcctcagcctcccgagcagctgggattacaggtgcacaccatcatgcctggctaatttttgtatttttagtagagacagggtttcaccatgttggccaggctggtttcgaactcctgacctcaagtgatcctcctgtctcggcctcccaaagtgctgggattacaggtgtgagccaccgtgcccagcctaattttaacttttaactatgtacatgcattactgtgcacaaccagctgtgggcaagtacagcccaatagcccctcctcttcactgtcttgagtatctcttgctcgttgttgagggcccgtctagcgccatgccccataggctgcctataggagtccttttgacccttcaggcacccacacaattgtggaaatgtggctggaccaacaaatagtgggagtgagtggtaatccatgtgtgacatgcgagaggtgcacatttttttctctctctcttttttttttccatagaaatataaaatgtttgtagaaatgtaaaatcttttgtttttctttttttttatttttccagacaggggttaactctgtcacccaagttgggctgcagtggtgcagtcacagctcactgcagcctcaacatcccagtctaagggatcctcccacctcagcctcctgagtagctgggactacaggtgtgtgtcatcacacctggctacttcttttattttctgtagaagcagagtctcgctatgttgcccaggctagtcttaaactcctggtctcaaacaaattctcccacctcagcctcccaaagtgctgggattacaggcatgaggcactatgcccagcctgtaatcttattagcacacagccatgccccccactttttttttttttatttttgagagaggttctcactctcacccaggctggagtgcagtggcatgataaggggtcactgcagcttcaacctcccctggctcaggcaatcctcccatctcatcctcccaagtagctgggactacttgtgcatgccaccatgcccagctaattttttgtattttttgtagagatagggtttcgccatgttgctcagactggtcttgaactcctagattcaagcattctgcccacctcagcctcccaaagtgctgggattaattacaggcgtgagccaccgcatctggccgcctgcctgtttcttaatgcattgtctatgggcgcttttacacggcaacagaggaattgagaagctgcaacagaactcacttaaaatattttacccggcacttgaagaaaacatttgtccactcttgaattctttttcatactttttctaggccacaggtatattattaacagattaaccattattttttttttcagctatagccaataataataaaaaagagcaactcacattgatggtgcccttattgtgtgtgtgtcgtttcatggcatcctgaagacagctgagagacagatgtgatcatgcctgttttacagatggaaactgaggtttggagggttgaagttgcttctgagtaaatggctgagtcagtgcaacttgaccccagttctgctccactcacccaacgttgctcagccgttttcggttgtttcagtttcactgcagacacttctctgttctccccctgccctccttctctcccccaaactctctctcttccttctcctcctttctcttcttctgctccccaatccccctcctcctctttcatcttcttcctcctcctccttcctcctcccagccctcctcctcctcctcaacctcctccccttctatctcctccccctcctcctctttcttctccctcgccctcctctcttcttttctctcccccaaccccctctctactgggcctttgcatgtgcccatcccccagcctggaaacttcctcctgttctggttaatttctgctcattctccaggtctcagtctacctttttgttgtcgttgttgttgttgttgagacggagtctcgttctgttgcccaggctggagtgcagtggtgcgatctcggctcaccgcaagccccgcctcccaggttcacgccattctcctgcctcagcctcccgagtagctgggactacaggtgtgcgccactgcacctggctaatttttcgtatttttagtagagatgcggtttcaccatgttggccaggctggtctcaaactcctgggctcaagcgatccacttgcctcagcctcccaaagtgctgggattacaggcatgagccaccgtgcctggtctccaggtctgtttaaatgtcatttcttcctaaagctttcctggctaattcgattcttcttctcaaatgtatcttggggggtgaaaggtctgagaagagggaggggcatagagataaaggaagcttccaacagaggtgcatcaccaatgcccttctcccaggtccgaggtcatacccctggctcgaggggaggcggcttccgatgcctggtccatgctggggtatcaagttccagccctctcaccccagtttgggacaattctgtaggaccgcctcactggcagagcttgctgagggagtaagctgaggcctttgtaggccacaaggttgagaccagcctgagcatcatagtagggccttgtttctatgaaaacatttttttaaaaaatgaaacttcccacatgacaatttttttttttgagacggagtctcactctgtcacccaggctggagtgcaatggtgcgatctcagctcactgccacttccgcctcccaggttcaagtgattctcatctcagcctctcaagtagctgagattacaggtgcccaccaccacacctggctaatttttatatattttagtagagatggggtctcgccatgttggccaggctggtcttgaactcctgacttcaagtgatccgctcatctctgcctcccaaagtgctgggattacagccatgagccacagcgcccggcttccccatgacaattttaaacatgagaactatgtatatgccacagtctggaacttgggatctcaaataatcttggattccttgttctcagtccccatacagaagggaggagggctggcctttggactcccccaaatctgggttcgaatcccagctccaccactgcaagtctggttgctctggaccagttacttaacgttctctaaatgtcagttacatccgtgagataagctacctcgcgggacttcattcagtccttcttcaaatatctgtagaatatttgtaggctgaggcctttgctgggaccgtggagaagcccaacttcctcctccctttcccccacttcctaggctttgatccagccctggagccttgatcgaattgatctctctttcaagtcttccagggaggctgtgactcaatcctagaaaccaggggcaggtccaggctgcctgtggtctacttgctccacttcctcaggtgctcaagggtgactcatcactcagtaagttcagagcagagggcgttctcctcaatgtgtgccaggagcacagcaggaatgtaggcaccctcagagctccccagaattccctaaccctggaccacactgtggcattgcagcctatgtggggctgaggctctgtttcacattgggtgcccaatggactgctttacaggacagatgccttgttatcctgctctgctccggtagaacaaatatttgtagaaggaccgaatgaagtcctgcaaggtagctcatctcacagacgaaactgatgtttagagaacattaaataactggcccagagcaaccagacttaaagtggtggagctgggattcaaacccagatttgggggagtccaaaggccagccctcctcccttctgtatggggactgagaacacggaatccatgaccatttgagatcccaagttccagactgtggcatgtacatagttctcatgattaaaattgtcacgtgagaagtttcattaaaattttttttttttttttttttttttgtagagacaaggtctcactatgttgtccaggctggtctcaagctcctgacctcaagcgatcctcctgcctcagcctaccaaattgttgggattgtaggtgtgaaccactgcactctgcccagaggtttcaaagtgaactttttttctttaatcaagatggggtctcactatgttgcccagactggtctcaaactcctgagctcaagcgatcctcccgccttggcatcccaaattgctgggcttacaggcatgagccactgcacctggcctcaaagtggaatgtttttagtggggggaaggtgctggatattactgtcagtcctttagaggaagtaaaataaatcctacaggtacattgacattctcaggtcactttcagagggatgagcaataaattcattcaatgccttctttactaaaagcattagagataaagaaattctggaagtaaatcttgctgaaatgcattttgtcaggggaactcagttgaacaaaaactaaaggttgagttcagaaaaggtaaatgtcttttaccaagatttagttcttttcttccaggtagatatgccttttcttaggatctggagtgagaggctgttggaaaataagggttggggaaagccacagatggaattttacaaattggagacagctacttaatagaaacggcatctcatcagacaagtcaaggcaactgttgaaaatatgacatgtctctctatcagccattcatggcccaggacactatggcaaccaaatccaaactgctggttcaaagagattagtctgaatcccaaaagaatcctaattctctcctgatttattaaggaagaaaacaacaaccgcctttatttgcaatattattgcattgcatgcaatcctaggaaaaggtgtggctgttatttttgaagaagtactcaccctatactagatacagtatgaaacattattcatgcgtcattgcatttatttctcacgtgatctcaagaggtagatgctactgtcatcctgattttaagatgaagaaagcaagccttagggagttaaagggaactgcccaaggtcaaacagctggaaagagacttggccagacgcaaaaacagtctgatgcccggttcaaggtcctttagtttcatctgtccagtaagtagacagagtatttgatacttgggctggactagacaaatctatgatgtgtaattgttctgtgaactcacagatcctagcgtgaagagttttttgttttgttttgttttggtttttttagatgcagtttcgctcttcttgcctacgctggagtgcaatggcgtgatcttggctcactgcaacctccaccttccgggtacaagtgattctcctgcctcagcctcctgagtagctgggactacaggcacccaccaccacgcccggctaattttttgtatttttagtagagatggggtttcactatgttggccaggctggtctcaaactcctgacctcaagtgatccacccgcctcagcctctcaaattgctgggattacaggcgtgagccactgtgcccggcctttttttttttttttttttagatagggtcttgctctgtcgcccaggctagagtgcagtggtacaatcatagctcactgtagccttgaattcctgggctcaagcgattctcccacctcaacctccctgagtggctgggactacaggtgcgtaccattacaacacctggctaatttttttttattttttaatattttgtagagacaaattcttgttatgttacccaaggtggtattgaactcctggcctcaagtgatcctcccaccttgtcctcccaaagttctgagattacaggtgtgagccactgtgcttaaccaagtgaagacttttttggctagctcaaccctgtaattccagcactttgggaggccgaggtgggtggatcacctgaggtcaggagttcaacaccagcacggccaacatggcaaaaccctgtctctactaaaaatacaaaaattagctgggcatggtggtgggcgcctgtagtccgagctactcaggaggctgaggcaggagaattgctggaacctgggaggcggaggctgcagtgagccgagatcacaccactgcactccagtctggacgacagagcaagactctgtctcaaaaaaaaccccaaaaacaaaaaacaaaaatcaaaacaaacaaaaagcccaaaggaggactttttcatgctgataaagaatgtaggataaacctgataccctctccaaaatctcttccaattttcctaacctctgtaccaatgaggacttcctttcctttctgactttcgatcaatgtaacaaaaataaaattgaagcagagaagggttaagtatgttgctcaaggtcttgcaggtgatttgggttagagccaatcttgaactcagccaggtgaggtggcacctggttccatgactggaccctccctgctgccctggtttgcgagaagattcttacacacatgtccctgatctccttgaagctttgattttccacctagagccccactgcagcatcctggttatctgcgcaagctctgttgttacactgaactggatggtgaatcctgggtacctgtgtggccttgggcaaaaaaaaaaaaaaaaaaaaaagcacctctctgagcttccatttctttcattctttctttccctttcccctctcctcccctcccctcccctccccttctctctctctctctctctctctctctctctctttctttgttggagtctccgtctgttgtgcaggctggagtgcagtggcgcaatcttggcttgctacaacctctgcctcctggcttcaagcaattctcctgccttggcccccctgacgagctgggattacaggcatgcaccaccatgccagctaatgtttgtatttttgtagagatggggttttgccatgttggccaggctggtctcaaacttctgacctcaagtattacgcccattttggcctcccaaagtgctgggattacaggtgtgagccaccacacacgttcttgggcctccatttctacagctattaaaaggaggccataatagtacctaactcctgggatattatcgtggctaaaatgagctaatgggccaggtgcggtggctcacatctgtaatcccagtactttcggaggccgaggcgggtggattacctgaggtcaggagttcgagatcagcctggccaacatggcgaaagcccgtctctactaaaaatacaaaaattagccaggtgtggtggcttgcacctgtagtcccagctactcgggagtctggggcaagagaatcgcttgaacccaggaggtggaggttgcagtgagctgagattgtgccactgcactccagcctgagtgacagagctagactccatctcaaaaactaataataataataataataataataataataataataataatatcataataagatgggcctggcgcggtggctcacgcctgtaatcccagcactttactctactaaatctctactaaaaatacaaaaattagccaggtgtggtggcgggtgcctgtaatcccagctacttgggaggctgaggcaggagaatcacttgaacctgggaggcggaggttgaagtgagccaagatggcgccattgcactccagcctgggaaacaggagtgaaactctgtctcaaaaaaattaaataaataaataagtaaataaataaataaaatgaactaatgcatgaagagcacttagttaaattaaataaataaataaaatttttaaaaaataaaattaattaaataataaataaataaataaaatgaactaatgcatgcaacaacttagcacagtgcctaggacataataggcactcgataagtgggctgggcgtagtggctcatgcctgtaatctgagcactctgggaggctgaggcgggcagatcacctgagctcaggagttcaagaccaccctgggcaacatggcgaaaccccatctgtacaaaaattacaaaaattagctgaccatggtgatacccacctgcagttccagctacttgggaggctgaggtgggaggatcacttgagcccgggagactaaggttgctgtgagcccagatcatgccactacactccagcctggtggacaaagctagaccctgtcacacacacacacacacacaaaagtggctatttcctcaccattccccccttggcaggtcacagcccagtccactccactcctccatggtctccattcttgtcgcctcgacaccagatggcctggattaggtgtgtaagaacatatttatgctccagttttctcttgtcaaattcctcatccttcctctccccttcccagatgttctccattctccgcaaatcctctacctcacctccatcttccacctgctctttggtcactctgtctcctactcaactaggaagaccctaggaaccctccacttggaccctaaatctctttgcattttaacctttcattcatgaattcattcattcgaaagatattattgagcatctactatgtaccaggcactaaggatactagagtaaatataataaacaggatcctggctgggtgaggtggctcatgcctgtaatctcagcactttcggaggtaaaggtgggtggatcgcttgaggtcaggagttcgagaccagcctggccaacatgacaaaacccgtctctagtaacaatacaaaaattatctgggcatggtggtggcacatgcctgtaatcctagcaacttgggaggctgaggcaggagaatcgcttgaacccaggaagtggaggttgcagtgagctgagatcacaccactgcactctagcctgtgcaacagagcaagactttgtctcaaaaaagtaaacacggtctctactcacatagagctcactggccaagagaaagggcagcaattcatcaaatatttaattacaaactcagataaatactataatgaaaaatgcagagattctgagacagtcaggggccataacctagcctaggttggtggttatggaaggcttccatatcagcatgtgtttctttctttctttttcttttttcttttcttttctttttttctttttcttttttttttttgagatggcgtcttgctctgttgcccaggttggagtgcagtggcaccgtctcatctcactgcaacttccacctcccaggttcaagcaattctcatgcctcagcctcccaagtagctggggttacaggcttgtgccaacacacctggctaatttttgtatttttagtggagtgcagtggaaccatctcggctcactgcaacttctgcctcccaggttcaagcgattctcatgcctcggcctcccaagcagctgggattacaggcgtgtgccaccacacctggctaatttttgtgtttttagtagagatgaggtttcacaaagttagccaggttggacagcacgagtttctatgcaacacactgtcctaaaacttagtggcttaaaacaacaacaatcattgatttcacccccaaatctgcaatttgggcaggatgtggcctggacagcaagtctgtgttccacatgccatgctcaacatggggcagcttgacaggggctggaggacccacttttttttggttgtctctgagatataatttacatgccataaatttcaccatgtgaaaccatacaattcaatgctttttagtatattcacaggattgtacaactattgctatctaattccacgatatttccttttccctaaaaagaaatcctatacttatctggatgtggtggcgcacacctgtggtcccagctactcgggaggctgagacagggggatcaattgagcccaagagttccaggctgcagtgagctatgatcgcaccattgcactccagcctgggtgacagaatgagaccctgtttctaaacaacaatgacaagaacaacaacaacagaatatataccattagcagtctcttctattccctcttcccctagtccctggaaacactcatctatcttctgtctttatagatctgtctgttctagacacttcaaatggaatatacactacgtggcctattgtgtctggcttctgtcactgagtacaatgttatcaagattctggaagacccactttgtggatggctcagtcacatggctggcaatttggtatttgctgtcaggtgggaactcagccagggctgtgggcagggatcccatttcttctctatgggggccccctccacgggctgcttgagcttccttatggcatggtggttgggttccaagatggagcatcctaacagagccaagtgggagcttttcatatcttttttttttttttcaattgagacaaagtctcactgtcacccaggctggtgtgcagtggcatgatcttggctcactgccacctccacttcctgggttcaagtgattcttgtgcctcagcctcctaagtagctgggactacaagtgagcgccaccacgcccagctaattattgtatttttagtagaggctaggtttgccatgttggccaggctggcatatttattaaaaaaaaaaaagagagagagagagagacagggtcttgcttgttgcccttggcaggtcacagcccagtccactccactcctccatggtcttgaactcctagtctcaaatgatcctcctgcctcatccttccaaagtgctgagattacagatgtgagccacgatgtccggccagcttttcaccttttatgaccagtttcagaagtcacaccatgtcacttccacagtagcctcaagctcgtctggattcaagggaagggaacacagaccacccttcacaacaggagtgtcaaagtcaccttgtttgcgttttaacttttcattaatgcattcattcattcaaaagatattattggccaggtgcagtggctcaaacctataatcacagcaccttgggaggctgaggcggatggatcacctgaggtctggagttagagaccagcctggccaacatggtgaaaccccgtctctactaaaaatacaaaaattagctgggtgtagtggcatgcgcctgtaatcccagctacttgggaggctgaggcaggaaaatcgcttgaacccgggaagtggaggttgcagtgagccgagattgcgtcattgcattccagcctgggtgacaagagtgaaaatccatctcaaaaaaaaaaaaaaaaaaaaaaaagtcacaccatgtcagttccacagtagcctcaagctcatctggattcaacggaagggaacacaggccacccttctcaataagagtgtaagatcactttgtttacattttaaccttttattcatgcatgcgttcattcaaaagatattattgagcatctactcatgaatgaataattgtggccacttttggaaaatacaagtgctacagcttccctgagaagatgatgttggggctgacagctgaaggataagcaggtgttacttaggcacaggtatggaagagcattcaaaaaacacagaacaacgtgttcaaaagacccgggggaacaattagcacactggaggaacttaaggcggccttgagtggcagaggcagagagaaaggcacttgtctgttgtgtgctttccatgactgctgtttccactcagccttcattgtccattttttcagaaacagtaccctaaattccctttggggaaccattgactcacccgccctcagccctctcagtggggctggctgcaggggtgggtgttaagacccaggtctagccattcaagacagttcacccagcctcgccagtctcactgattggttcgggtgtggtcatgtgacactcagaagggccaatgaggctcaaacccaagacatctgctgcagctattggacaagacagagtgtattgccttggggttgctaggtaggatagaggcaggagtggttgggtgtcacctttgcctctgccagagaataacctgttgaaatgacaccaacaaagagaaagtagaacgaagtgacacagaccattgagctcctggactatgaccaaagccagctctgccactggacattttagattcatgggccaatacatgatggtttaggctaatttgaatttctgtcacctggaatcaagagtactgtttaaaggcaccatcggtgggcgcagtggctcatgcctgtaatcccagcactttgggaggccgaggcgggtggatcacccgaggtcaggagtttgagaccaccttggccaaaatggcgaaactccatctctactaaaaatacagaaaatagccgggcatggtggcacgtgcctgtaatcccagcaactagagggtctgaggcaggaggatggcttgaacctgggaggcagaggttgcagtgagccatgattgtgccactgcactccagcctgggcaacagagtgagactccatctcaaaaaacaaacaaacaaacaaataaataaataaagacactatggttaggatttttctcttcctgtccctaactacacattctccattcctggttcttacgtaccacttcagaagcctccagcacttcatctggcctctcttccttctctctctctttcatttcttattttttttgagacagagtctcgatctgtcacccaggctggagcgcagtggcgcaatcttggctcactgcaacctccacctccaaggctcaagtgatcctccagcctcagcctcctgagtagctgggattacaggcacacaccaccactccaagctaactttttgtatttttagtagagactggtttttgccatgttgcccaggctggtcccaaacttctggccccaaacttctggcagatcaagtgatccacctacctcggcctcccaaagtgctgggattacaggtgtgagccactgcatctagccttctctcttttttttgtgatcaataaatgtttgtttattgcatcttggtctgaatgtcatattaaatttggggttccaaaaaactctagaaaacatttatgagaacttgggaggtggaggttgcagtgagccgagatcgcgccactgcactccagcctgggtgacagattgacacttcgtctcgccaaaaaaaacaaacaaacaaaaaaaaaaaacaaaaaaagaaaaaaagaactaaatgtccctgaatataaaatggtaggtaagaacagtaattggcttgtcgatcaatgatgaatcaaacagaaaatgcgtgacagattatggggaagtttaaaatgtccaaatattatgtcccagaagaatttgtctagataatagatcttcctcagtccctttcaggggatggatggatagtggacatacttgggcaggtttattcagggtaagctggaggaatgtgtcaaataggtagctacctatctgatttactttcatcctattttttctgctcttaaaacaaaataacctcctattggttaaacttttttttttttttggttgcaaatcaaactctcttactggttttaaaatatcaatttcttttctttttctgtttctttttttttttgaggcggagtctcactctgtgacccaggctggagtgcaatggcatggtcttggctcactgccacctccgcctcccgggttcaagcgattctcctgcttcaggctcctgagtagctgggactagaggcatgtgccaccacacctagctaatttttgtatttttagtagagacagggtttcatcatgttggccaggctggtctcgaacttctgatcttgtgatctgcccgccttggcctcccaaagtgctgggattacaggcgtgagccaccgtgcctatcctattttttttctttttctttttctttttttaagatgaagtcactctctgttgcacaggctggagtgcagtagcacgatcttggctcactgcatcttttgcctcctgggttcaagcgattctcagcctcctgagtagctaggactataggcgcgcgccaccacgcctggctaatttttgtatttttttacagagggggtttcactatgttggccaggctggtctcgaactcctgacctgaagtgatccacccaccttggcctcccaaagcgctgggactacaggcatgagtcaccacgcctggccaaaaaaaagattaatcttaaacataaccagaagtctagatgtttgacaggtttatttatttattgagacaaggtctagctctgttgcccaggctggagtgcagtggcgtgatctcttgggtcactgcaacctccacctgtgggttcaagacaccctcccatctcagcctcctgagtagctgggactacctgcctggctaagttttgtatttttagtagagaccaggtttcaccatgttgcccaggctggtcttgaactcctggcctcaagtgatccagcacctggcctcctaaagttctgggattacaggcgttggccaccatgcctggtcagtttggcaggtttaagggttgacttatgcctgtgactgtggctatctttctttatattctcatggcttaccccaggctggccacttgtaatatatggtcatcttaaccaaattagaaaaaggtattccagttgatgtggtggctcacgcctgtagtcccagcactttgggagaccaaggtgggtaggtctcttgagcccaggagtttgagatcagcctgggcaacataacaagacctcgtctctacaaaaaatacaaaaattagctgggcatgattgtgcatgcctgtagtcacagctactcgagaggctgaggtggagcccagaaggcagaggttgtagtgagccaagatgggaccactgcaccccagcctgggcaacagagccaacctgtcttaaaaaacaaaaaacaaaaaacctgacatgggactttgaatattctagtattgaatgaatgaggaataaagagatggatgggtggatggatggacggacagatgaatgaattgatagatggatgagttgaatgggtgatggaaggatggatggatggacaggtggatgaatggatggatgggtggtggatgaatggatggacaactgaatgaatgaatgaatgaatagattgacaagtggatgggtgatgggtggaaggatagatggtcagatggatgggccatggacggatgaacggacagatggatgagagagagagagagattcctctgggcagcagacaatttccttaaaaacaaacaaacaaaatctcctttttcgggaagatacaaccacacatacgggctgaatgtcagcccccaatcatctactcggcacttccatagcacagggcacaattttgggcaagtgctcatttcgtgaggaccacagacaggcaccatttttttaagggttggtgggatgatcaccactgtttgaggccttatattcaaggattacaatgttcagaggagaaaatagaacgacttccaggatctctgccagagcgccaggaagaacttcctcggaaacatttaacaaaactctcctcgtatctcattggcctgatttgagttacatttcctttcttttctttcttttttctttttctttctttctttctttctttctttctttctttctttctttctttctttctttctttctttccttccttccttccttccttccttccttctttctttctttctctctctctctctctttttttctttccttccttctttttttttttcttttttttgagacatggtccagctttgtcgttcaggctggagtgcagtggcacgatcttggctcactgcaacctccgcctctgggttcaagcaattctccccgcctcagcctcctaagtagctgggattacaggcacccatcaccacgcctggctgatttttgtattttttagtagagatggggttttaccattttggccaggctggtcttgaacccccgaccttaggcgatccgcctacctcggcctccgaaagtgttgggattacaggtgtgagccaccgcgcccggccttctttctttttttgaggtaagattcacaaaacatttttaaaatcaccctttggggccaggcatggtggtgtgtgcctgtagttccagccactagggaggctgaggcaggaggatcacttgggcccaggagcctgaagtgcgctatgatcactccactgtacttcagcgtgggtgacagagtgataccctgtctcaaaaaaaaaaaaaaaatcaccatttaaagtgaatagttcactgttttttgtcacattcacaatgttccacagctatcatcactatctagaacatttttaccacagcaaaacaaaagaaaaaaacaaaaagcaaaacaaaaaacaaaaaaccataaccattaagcaaacattctccattccgcccctcctcctaggccctgagaaccacaatctacttcctgtctctccggctttgcttattccgtgtgtttcatcccatataaatatattcataaaatatgtggtcttttgtgtctgtgtctgtttccttcctctccctttctttctttctttctttctttctttctttctttctttctttctttcttcctttttctttctttctttccactttctttctttcttcctttctttttctttttctttcctcttttctttcatatcatggctcactacagccttgacctcccaggttgaagagatcctgccacctcagcctcccaagtagctgggactacaggtgtgcaccagcacccctggctaatttttgtatttttttgtagaaacgtgctgttgccatggtgcctgggctggtctggaactcctgagctcaagcaatctgcccaactcggcctcccaaagtgctaggattaccggtatgagccactgcgcctgactggggttcttttttgtagcatgatgttttcaaggttcatgccagttgtagcatgcatcagtattttcttccttttcatgtctgaatgatattccactgcatagataaactaaatattatttatccagtcgttaattgatgggcatttgatttgtttccactttatggaccgttacgaatagtgctgctatgagcatttgtgtgccagttaatgtttgaacacctgtatactagtatacacccaggcattaaattgctgggtcatattgtaattctatgttcaactttttgaggaactgccaaactgttttccatagaggctgtaccattttacattcctagcagcaatgtacaaggcttccagtttctccatatccccatcaggcttgtaattttccttttttttttttttttttttttttgacacagagtctcactctgtcgcccaggctggagtgcaggggcgtgatctcggctcattgcaacctctgccccctgggttcaagcgattctcctgcctcagcctcctgagtagctgggattacaggggcctgccactgtgcctggatgatttttttgtatttgtagtagagatggggtttcaccatcttggccaggcttgtcttgaactcctgacctcgtgagccatggcgcctggctgtaattttccatttttaaaaattataaccattctattgtgtgtgaagtggcatctctttgtggtttttatttgcatttccctaataacgaatgatgttgagcatctgttcacgtgcttgttggccatttgtagatcttctttggagaaatgtcttcaaatccggggcccatttttaaaaactgggtgctttgctttttttgttgttgagttgtaaagttctttacatattccagacagtagagccttatcaaatatgtgatttgcaaatattttctctcattctgtgaactgccttttctgtccttcgatactgttctttgatgcataaaaggttttaattttgatgaagtctagtttctcaacctttgctgttgtcacttgtgtttttggtgtcatatttaagaaaccattgccaagccaaagataatgaagatttccctctgggctctcttttaagtattttatagttttaacttttataatttagatgttaatattatggcgtgagttcaaagtccaatttcattcttttgcatgtggatatctcatggtcccagggtcatttgttgaagagactgttctattaaattatgtcttttaggctgggcacggtggctcatgcctgtaatcctagcactttgggaggccaaggtgggtggatcaccagaagtcaggagttcaagaccagcctggccaacatggcgagaccctgtctctactaaaagtgtaaaaattagccaggcatggtggtgtgcacctgtagttccagctacttgggaggccgagacaggagaattgcttgaacccgggaggtggaggttgcgtgtgccgagattatgccactgcactccagcctggatgacagaacaagactccatctcaaaaaaaagaaaaaaaatatatgcctttttcagcaatttggatggagctggaggccattaatctaagtgaagtaactcaggaatggaaaaccaaatattgtatgtcctcacttataagtaggagctaagctatgagtacccaaaggcatacagagtgatataaaggactttggagtctcagaagggggaggatgagaggagggtatggatgaagactacatgttgggtacatgtgtaactacttgggtgatgatgggtgcattaaaatctcaaaatttaccactatataattcatctatgtaaccaaaacccacttgtaccccaaaatctattgaaatttttaaaaaaagagagagagggaaactgttctttcgcctattgaatggccgtggcacgcttgtcaaaagccgattcactggctgggcatggtggctcacacctgtaatcccagcactttgagaggccaaggtgggtggatcacctgaggtcaggagttcaagatcagactggccaacagggtgaaagcccgtctgtactaaaaatacaaaacttagccaggcgtggtggtgggtgcctgtagtcccagctactcgagaggctgaagcaggagaattgcttgaatccaggaagtggaggttacagtgagtcaagaattcgacactgcactccagcctgggtgacagagcaagactccatctcgaaaacaaacaaacgaacaaacaacaacaaaaagccaactgaccacactgggtgcagtgggtcacgactgtaatcccagcactttgggaggtcaaggtgagaggattgcttgagcccaggagtttgagaccagcctcagcaatatggcgagacttcatttgtactaaaaacaaaaaacattagccaggtgtggtggcacgtgcctatactcccagctactagctatgtgggaggctgaggtgggaggattgcttgagcccaggaggtagtggttacaatgaactgtgattgcgccactgcactccagccagggcaacagagaaaatgctgtctcaaaagaaaaaatcaattgactatagatgtatgggtcatttccagactttcaattctattccactaatctatatgcctatcctcataccagtatcacaccttttgattattgtggctttgtagtaaattctgaaatcaccaagtgtgagtcttccaactctgctcatttttcaagattggctcttgggtgcaataccatgtgaatattaggtttgaattttccaggtctgcaaacaaggacgttgggattttcatagggattatatcaagtccatagatcactttgggatagtattatcatcttaacaatattaagtcttctaattcataaacacgtgtattagtctgttttcatgctgctgataaagacatacccaaggctggggagtttacaaaagaaatcggtttaatggtcttacagttccatgtggctagggaggcctcacaatcatggtggaaggcgaaaggcattttctacatggcggtggcaagcgagagaatgagagccaagtgaaacgggtttctccttataaaaccatcagatcttgtcagacttattcactaccacaagaacagtacgggaaaaactgcccccatgattcaattatctccccctgggtcccttccacaacacgtgggaatcatgggagtacaattcaagatgagatttgggtggggacaaagagccaaaccatatcaacatgtgacgtcgtctttctatttatttaggtcttcgtatttgctttcagccacgttttgtagttttcagggcactagtgttactcctacttggttaaatttatttatttttattctattggaagtgaaattgttttcttaattttactttctgattgtttattgctagtttatggaaatgtggctgatgtttgtgcgttgatcttcttttttttttttttttttttgagatggagtcttgctctgtcacccaggctggagtgcagtggcatgctcttggctcacagcaacctctacctcctgggttcaagtgattctcctgcctcagcctcccaagtacctggaactacaggtgccctcaccacgcccagctaatttttgtattttttactagagacaggctttcaccatgttggccaggctggtctagaactcatgacctcaagtgatccacccacctcggcctcccaaggtgctgggattacaggcatgagcaaccacgcccagctgcaaactaccttttcaatgacagttgtctcctaatttgttggcctcagcataggtagataataataaaacctacattttaaaacattaaagggcaatgttcagccaggcacagtggctcacgcctgtaatttcagcactttgggaagctgaggtggacagatcacctgaggtgaggagttcgagaccagcctggccaaaatggtgaaaccctgtgtctactaaaaatacaaaaattacctgggcatggtggccgacacctgtagtcccagctacttgggaggctgaggcaggagaattgcttgaacccaggaggcagaggccacagtgagccgagatcgtgccactgcattctagcttgggtgacagagagagaagcggtctccaaaaataaataaataaaaatagatgagtcacttccaagatggccaaataggagcagctccggtctgtagctcccagcgagatcaacacagaagacaggtgatttctgcatttccaactgaggtacctggttcatctcactgggactggttggacagtgggtgcagcccacagaggtgagctgaagcagggcagggtgtcgcctttcccaggaagtgcaagggttcaggggatttccctttcctaggcaagggaagccgtgacagactgcacctggaggaacggtacacttccatccaaatactgtgcttttcccacggtcttagcaactggcagaccaggagattctctcccgttcctggctcggcaggtcgcacgcccacagagccttggtcactgctagcgaagcagtccaagatcaacctgtgatgctgcagcctggtcagcaactatcatcagactgaacaggcaatctacagattgggagaaaacttttgcaatctgcccatttgacaaagggctagtattcagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcacgccagttcgaacggtgatcattaaaaagtgaggaaacgacagatgctggagagggtgtggagaaataggaatgcttttacactgttggtgggagtgtaaattagttcaaccattctgcttaatagccacacactgtgtggctattcctcaaggatctagaaccagaaataccatttgacccagcaatcccttcactgggtatatacccaaaggattataaatcatgctactataaagacacatacacacatatgtttattgtgccactattcacaatagcaaagacttggagccacccaaatgtccattaatgatagactggattaagagaatgtggcacatctacaccacggaatactatgcagccataaaaaaggatgagttcatgtcctttgcaaggacatggatgcagctggaaaccgtcattcttagcaaactatcacaaggtcagaaaaccaaccaccacatgtttcactcataggtgggaattgaacaatgaaaacacatggacacagggcagggaacttcacatattggggcctgttgggggtagtgggggcggggagggagagcattaggacaaatacctaatgtaaatgtcgagttgatgggtgcagcaaaccaacatagcacatgtatacctatgttacaaacctgcacgtcgtgcaacgtcgtgcaaatgtattgtagaagttaaagtataataaaaaaagaaaaaaaatccattcatatatcaataaaaaatagatcaatcaatcaataaaacattaaagtgcaatgtcgacaagaggtggtaaaagcaggcatccttgtgttgttcctggtctttgtggggaaatctttaaatttgtaagcctttcactgttgcatatggtgtaagtctcttcctttctttctttctccttccttccttctttccttccttccttccttccttctttctctcttccttctttttctttctttctataaatagaaacagcaggccgggcacgctggctcagcctgtaatcccagcactttgggaggccgaggcaggcggatcacgaggtcaggagatagagaccatcctggttaacacagtgaaactccatctctactaaaatacaaaaaaaaaattagccgggcgtggtggtgggcgcctgtagtcccagatactcgggaggctgaggcaggagaatggcctgaacccaggaggtggagcttgcagtgagacgagatcatgccaccgcactccagcctgagcgacagagcgagactccgtctcaaaaaataaataaataaaaataaataaataaatagagccagcgtctcactatgttgcccaggctggtctcaaacttctaggctcaagcaatcttcccaaagtactggggttacaggagtgagtcaccttgcctggcctggtgtaagttttttatatatgccctttatcctgttgaagaagttctcttctggtctttattatttcagtattctttgttgttgttgttgttgttttgttttgttttgttttaaatcctgaaaaggtgttgggttttgtcaaaggctgttttctacattatcccttaattctattaatgttgtgaataacatttatttatttatttatttatttatttacttattttgagatggagactcactcagtctcccaggctggagtgcagtggcatgatctcggctcactgcaacctccatctcctgggttcaagcaattttcctacctcagcctccctaacacctggcattacaggcgtgtgtcaccacgcccagctaatttatttttattttttgtatttttagtagagacggggtttcaccgtgttggccaggctgatcttgaactctttacctcaaatggtccacctgcctcggtctgccaaaagtgctgggaatacaggcgtgcactaccgtgcctggctgagttttttcttttttgagacagggtctcactttgtcacccagggtggggtgcagtggcacaaacatggttcaccgcagcctcaacctccccagctcaagtgattctctcacctcagcatgccaagtagctgggactacagttgtgagccactgcgccctgccctgattttcttataatgaatcacccttacattcttgggataagtctcatctgttaacacatatgtataatatgtttctatgctgctggatttgatttgctagtattttctttaggatttctgcatctatatttataagggacattggtctatagtttccttttcctgtaatgtcattgtgtggctttggtatcagggtaatgctggcctcatagagtgggtcagaaatgttgcctcctcttctagttttgggaagattttaataagaattggccttaattattcaaatacctggtagaattcaccaatggagccatcgggtcctgagcttttccttacggaactttaaaaaattgttaccaattccatctctttccttgttatagatctattccgacttcctagtttttcttgggttagtcttggtaatttgtgtgtttctagaaatttgtacatttcttccaggtgtattcaattaattgacatgtcattgtttatagtattctcttataatcttttatttttgtaagggttgtagtaatctttggttcctgattttagtggtttgggccatctccattcttcttctgggggcatcagtatttccaaaagtttagcaattttgctgatttgttaaagaaccagtttttggttttgttgactctattgcttttatagaatactatattttatttatcttcactgtaatttttattgtttttttgctgctgcttgctttcggcatagtttgatctttttctaatcccataaggtggaagaatgtattatttatttgagatctgtctttctttttttgcttgagacaaggtcttgctctgttgtccaagctggagtgtagtggtgcaatcatggctcactgcagcctcaaactcctgggctcaagtgatcctcctgcctcagcctcccaagtagctgagatcacaggcatgtgccacgatgcctggctagattttttatttgtatttttcatacagatagggtctcgctatattactgaggctggtctcaaactcctggcctcaagtgttcatttttttttttttttttttgagatggagtttcactcttgttgcctaggctggagtgcaatggcacgatctcagctcaccacaaccttcgcctcatgggttcgagtgatccacctgcctcagcctcctaggtagcaaggactacaggcatgtgccaccatgcccagctaattttgtctttttagtggagatggggtttctccatgttggtcaggctggtcttgaactcctgacctcaggtgatccacccgcctcagcctcccaaagtgctgggattacaggcgtgagccactgcgcccaccctctttcatttttgatgtaggtgactacagctataaatttccctctgagcattgtctttgctgcatctcataagttttggtaagttgtactgctttttcattcatctcaaaatatttaaaaatttttttatgatgtcttattttactcattgtttatgttaatttctacataatcgtatatttgtgaatctaaaaattttctttctcttgttgatttctagttttattctgttgtggttgaagaaattactttttttttttttttttggcagggtctcactctgtcgcccaggctggagtgcaatggcctgatctcagctcactgcaacctccgcctcccgggttcaagcaattctcctgcctcagtctcccaagtagctgggattataggcacccgccaccacacccagctactttttgtatttttaatagatatgcggtttcaccatgttggccaggctggtctcaaactcctgacctcaggtgatccgcctgcctcggcctcccaaagtgctgggattacaggtgtgagccaccgcacccggccaaaagtactttgtatgatttcaacttttttttttttttttttttttttgagacagggtctctctctgtcgctcagtctggagtacagtggcgtgatctcagctcactgcaacctccacctcctgggttcaagcaatcctcctgcctcagcctcctgagtagctggaattacaggtgcccacaaccatgcccagcaaattattgtacttttagtagagatggggtttcactgtgttggccagggtggtctcgaactcccgacctcaagggacccacctgccttggcctcccaaagtgttgggattacaggcgtgagccaccgcgcccagccgataactcaaaaattttcaagaggcaaagacttattttttaacagatgtgagactcagtgttttaaacaagacccaataaagacagtatgaggctaactgaatctgtccctcctgcaaagaaacatttttttactgttttttaatattacatgaaaattttgtttaaaaaactaaattttacctttgtatgtaaaattgttcctttagtagttttaattacatatattataatgttaactcttaggcagtctccgcctctcgggttcaagcaattctcttgcctcagcctcccgagtacctcagactacaggtgtgcaccaccatgcatgcccagctaatttctgtatttttagtagagacagggtttcgccatgttggccaggctggtctcaaactgctgacatcaggtgatctgtccgccttggcctcccaaagtgctgggattacaggcgtgagccactgcatccagccattactgacttttatttttaatgaaaaactaaggaggtaggcaattttaattatgtaccaggtacagagtctaggacagtaataatatatgtcaataatatatgatgctttttaggataggcaggggacatggttaattctacacatccccaggccttatctacaatctaagggctttaaaatagacaagtccaacaattatttaaaatattatagaagggccaggcatggtgcctcatgcttataattctagcactttgggagcagaggctggtggacgccttgaacctaggagttagagaccagcctggccaacatggtaaaactcgatctccactaaaaatacacaagtgagctagacatggtggtacgtgcttatagtcccaactacttggaaggctgaggtggaaggatcacctgagcccagggaggttgaggctgcagtgagcatgccactgtactccagcctgggcaacagagtgagtcccagtctaagaaaaaaatttataaaagtagtttaggacctgaaaggtcttagtaaagacaataccagacttgtctaatttacaccaaatgttcacattctgaagatgtttttattttactaataattgaaaaactgtctttatttactaaagattattaaagtcatgtgaactaaaagatacttaaagtttttattttttgatgaaatattcaatttaagtggttaagtcaactgattagagcttttaaaaatatatttcagtagtgaaatattatatattcatggcacatataaacatagacataacagacagaagtagatcttatagacttgtaagactttctgtcaattttaaaatttttattaattaattaatttattagagacaaggtctcactctgtcacccagactggaatgcaatggtataatcatagctcactgtagcctcaaattcctgggcttaactgatcctctcgcttcagcctcctgagttgctgggactacaggcatgcaccaccatgcccagataattttaaaaattttttatagagatggtgtctcactttgttgcccaggcaggacttgaactcctggcctcaagtgatcctcatacctcagcctcccaaagtgttggaattacaggcttaagccaccacatctggctggttttaattattaaacaataacaaaaaaattcattttctaaaaaaaagagtactgtggcctctatacaaaaataaagaaaaacaatttagcatagtgaaaacaagatagagtcaataatattaaatttgtatttttgagacagagtctcactctgttgcccaggcttgagtgcagtggcttgatctcagctcactgcagcctctgcccccctggttcaagcaattctagtgcctcagcctccggagtagctgggactacaggcttgcaccaacatgcttggcttatttttctatttttagtagagacagggtttcaccatgttggccaggttggtcttgaacccctgacctcaagtgatctgcccgcctcagcctcccaaagtgttgagattacaggcgtgagccaccgcgcccagtcaattatgttaaattacccttattactatgatttttataaaagtggtttcaagcatataaagaatgtttgttattactattatgtattattttctttatcatgatacttcagtcaaaaggaactgcttaggacagcttgaatatgtcccatagttacagcctgcaagcctttttctttgctgtgccatgtgcctaagacaccatccttcgtttgtgtgtgtcaaaaccccaccagtctgtcctcttaatcccaacaccaatgtcctgggtgccaataaaggctttcctcacctccaaattgagattttattgacctctcttggggtgcttatactggctttgggttgaaatctattttttctcctctcccttgaagaagcacgtctctttgcttaagggaacgtagaagccacagcagatcctagcagatatctgttaccctgaagaagaggtcagggcccaggcacggtggctcatgcctgtaatcccagcatttggggaggtcgaggtgggcggatcgcttgagcccaggagttcgagcccagcttgggcaatatggcaagacaccgccccccgactctacaaaaaatacaaaaattagccaggcgtggtggtgagtgcctgtagtaccagctacttgaaaggctgagttgggagaatcagctgagcccaggaagttgaagctgcagtgagccgtgatcgcaccactgcactccagcctgtgcaacgtggcaaaaccagagtggggccttgtctcattttaaaaagtaataagagaccgagcacgggaactcaggcctgtaatcccagcactttgggaggctgaggcggccagatcacttgaggccagagagttggagaccagcctggccaacatgggaaaaccctgtctctactaaagatacagaaattagccgggtgtggtggcaggcacctgtaattgcagctactgggaggctgaggcaggagaatcgcttgaatctgggaggcggaggttgcaatgagcagagatcgagtcactgcactccagcctgggccgcagagcaagaccctgtctcaaaaataaataaataaataaataatttaataaataagaagaaagggtcagggccatttttaaaaggcactagataaggcctggttgcaatcagggagtgcgggcaactgatttctttgaagcctcctcttgttctgtttccgtgacattgacagggaccagctcccatggttcaggagctgctgagggttaacatcctgtcccaggagggatctgaccacaccaatggctttatcgttgcctaattggggaggccctgtgggggatgtttcaaggactgagagtgcagaggagcctcccgcatgcagttacgctgatggaaacacaatgggtggattgccacaggggcccgcaggctcgctggcaaacagagcgcacaggtggaaaccttccccgctgaccagatactttgtttcctttctggggaggcagataaaacagttaccataacccaaaccctgcccactcttcatttgcaaactgcaatgctcttagacatcttccttaggtaagcgctttgagagctcctgttcatttcaggactaaaatgaacaataatagcgaccgtccttcagagcctgctggatgccaggcacctcacaagtgtctcccagtgctgggtgcagtgattcacacctgtaatcccagcactttgggaggctgaggtgggtggatcgcttgagctcaggagatcaagaccagcctgggcaatatagtgagaactctgcctctaaaacaaagaaaaaggaaaaagtaactcctggtgaatttccaccttagaacaagagtgggaggtgtcctattcatgatctttaatgctttgctcaaatatcaccttctctgtgaggcctaccctgaccactctgcttaaaattgcaaccctccaccacctccaccccgcatcgcaagttctcgtcacagcctttctcacctgctacccactccatgatttacttattaagtatgtttgttaggccgtgtgcagtggctcatgcctataatcccagcactttgggaggctgaagcaggtggattacctgaggtcaggagttcaataccagcctggccaacgtggcgaaaccccatctttacaaaaatacaaaaaagttagccaggtgtggtggtgcgtgcctgtagcccagctactcgggaggctgaggcaggggatttgcttgaacctgggagggaaggttgtagtgagctgagattgcaccatcgtactccagcctgggcggtagagcaagactctgtttcaaaaaaaaaaaagtattgctaagtcaaaaagtataaacagtctaattttttttttttgagacaaagtctcgctctgttgcccaggctagaatgcaatggcacggtttcggctcattgcaacctctgcctcctgggttcaagcgattctcctgcctcagcctcccgagtagctgggattacaggcatataccaccatgcccagctaactttttgtatttttagtatagatagggtttcaccatattggccaggctggtctcgaacttctgacctcgtgatccgcccgccttggcctcccaaattgctgggactacaggcaagaaccaccgtgccctgcctgaagagtcgaaatttttttttttttaaacagtttcactctgtcgcccaggctggaatgcaatggcacattctcagcccactacaacctccgcctcccaggttgtagccattctcctgcctcaagcctcccaagtagctgggattataggcacccaccactatgcctggctacattttgtagtttttttttttttctttttgagacggagttttgctcttgcttcccaggctgtagtgcaatggcgccatctctgctcaccacaacctccgcttcccagattcaggtaatcctcctgcctcagcctcccgaatagctgggattacaggtatgcgccaccacgcccagctaattttgtgtttttagtagagatggggtttctccatgttggtcaggctgaacaaccgacctcaggtgatctgcccgcctcagcctcccaaagtgctggaattacaggtgtgagccaccacgcctgggtctactttttgtagtttttagtagagacagagtttcaccatgttggtcaggctggtctcgaactcctgaccttagtcgatctgcccgcctcagcctcccaaagtactgggatcacaggcgtgagccactgcgcccggcccaaatagtctaaattttaataaatactgccaaataacactttcaaaagagtatccattcatactcccaccaatggtacataaaaagtctcaataacaattggtaaaattggtttggtggggaattcaactctacactgctgagctgctgctatttgcaaccatagaatcttttttttttttttcttctgagacagagtctcgctttgtcaccgagactggagtgcaatggcgctatcaaggctcactgcaacccttgcttcccggctttaagtgatcctcctgcctcagcttcccgactagctgggattacaggagtacgccaccatgcccagctaattttgtatttttagtagagacagggtttcaccatgttggccaggatggtctcgaattcccgacctcaggtgatctgcccgccttggcttcccaaagtgctgggattacaggcgtgagccaccgtgctgggccctgcaaacatagaatcttagagttgaaagggacataaaaatccatcgaattcttgtccaactcccctcccaaggcagcaatcccctgcaatacagccttgtttacaacgctgttgtctgtgactggggtcaaactccacatctttgatcttaagaataaaccaccactgacagtgggcttatcacatccagtaagtttgttatatcactgggccaaaatctactttcctggtggggcccggtggctcacgcctgtgatcccaggactttgggaggctgagtagggtggatcacctaaggtcaggagccagagaccagcctggccaacattgcgaaaccccatctctactataaatacaaaaactagctgggtgtggtagtgcatgcctgtagtcccagctactcggaaggctgaggcaggagaatcacttgaacccaggaggcggaggttgcagtgagtggcgatcactgcactgcactccagtctgggtaacagagcgagacacacacacacgcacacgcacacgcacacgcgcgcgcgcacacacacacacacaccctacctttcctgcaacacaccccacctatcctagctcagctctgggaagtaacacaaaagagctaatccttttccacatgacagcccttaaaatatttgaagactgtatcacatttccccagagccttctttttgtggggtacaacttcccagttgtgaccaaacacgtcccttccataggaaagtgctgactggagtctcttcagctgagtggcccagcataagagctttagagtcactaggcttgggttcaaggccatgttcccaccccttccagccacctgacctgggctaaatcacttctcagactagtttcctcccttggataaactgcatagcaataatacccatgtcatagggttgctggtttggccacattatgattttttttctttttgagacagagttttgctcttattgcccaggctggagtacagtggcacagtcttggttcactacaacctccgcctcctgggttcaactgatttttcctgcttcagcctcccgagtagctgggattacaggcacctgccaccatgcccagctaattttttgtatttttagtagagtcggggtttcaccatgttggccaggctggtctcgaactcctgacctcaggtggtccacccgccttggtctcccaaagtgctgggattacaagtgtgcgccactgctggccttttttttttttttttttttttttttttttgagacagagtcttactctgtcacccaggctgaagtgcagtggcatgatctcggctcactgcaacctccgcttcccaggttcaggtgattctcttgcctcagcctcctggtagctaggactacagacacccggcaccacactcagtcacatggatttttttggtgggttccttcctccataagaaaaaaagtgttttaaatcatattttatgactgtgttagtataaggatgaatataacaaggcctggtgcagtggctcatgcctgaaatcccagcactttgggaggccaaagtgggagaattacttcatcccaagagttcaagaacagcctgggcaacatggcaagaccctttctctacaaaaaataaaaaatataaaaattagccggaagtggtggcatgtacctgtggtcccagctcctcgggaggctgaggtgggaagactgcctgagcccagggggtcaaggctgcagtgagccatgattgtgccactgcactccagcctgggcgccagagctcctgctcaaaaataccaaaaactaaaaactaaaaataatatatatatgtaataaaggcagggttatgtttattttttcttctgattttaaaagaagtaaaacattttcatggggccctaaaagtattgtgggccttaggcatcatgccttctgtaagttcataggccctggctgctggaaggagtaaaaaagaaaaaacatgccaaatatgtaaagtgcttagcgcagcactgggcctggctctttgtaacttaataaatggtgatcaaaaattaaaaagtgcaatgcaggccgggtgcagtggctcacgcttgtaatcccagcactttgggaggccaggtgtgcggatcacgaggtcaggggtttgagaccagcctggccaacatggtgaaaccctgtctgtactaaaaaacacaaaattaaccaggcatggtggcacacacctgtaatcccagctacttggaaggctgaggcaggagaattgcttgaacctgggaggtggaggttgcggtgagtcgagatcacaccattgcattccagcctgggcaacaagagtgaaactccgtctcaaaaaaaaaaaaaaaaaaagttgggggtgtagtgcagagaacagagtgtaaccctggagaactctgcagagctttccttttttttttttttttttgagacggagtctcgctctgtcgcctaggctagcacaatctcgactcactgaaacctctgcctcccgggttcaagtgattctcctgcctcaccctcctgagtagcggggattacaggtgcatgccaccatgcccggctaattttttgtatttttagtagagacatggtttcaccatattggccaggctgctcttgaactcctgacctcagttgatctgcccaccttgacctcccaaaatggtgggattacaggcatgggccaccacacctggcctgcagaactttctttattggcatgcattgggacttgcagactcagcttcagctgaatgtaaggaacagttcctgggtccatgttttctcactgtgttcacagagtcttgcaagagattctgcaaaaagacacacagtctatggcatttatcttgagacgagagaaagtatacatttaaggacatgtgcgtgaagaattctggaaggataaagaagatattaatttatagccattacctattgagaaggaaggattgggaatattgtgaataggtccaggagtgggagagagactttccactgtatgcctactgatagttttgatgtgtaaacaatgataatagagtgctgattcaaaaatgttaataattttttttttttttttttttgtgatggagtctcactctatcacccatgctggagtgcagtggcgcaatctcagctcacttcaacatctgcctcccgggttcaagcggttctcctgcctccacctcctgagtagctggaataacacttgtgcaccaccacacccagctaatttttgtatttttagtagagacagggtttcgccacgttggccaggctggtctcgaactcctgacctccggtgatctgccagcctcggcctcccaaagtgctgggattacaggcttgagccactgcacctggctcaaaaatcttagtaatttttttgactgtcctaaattgtttattaggtatgagttttacaaactttacttatattagtggtaacagtggagattgagagtattgcgccttctccaagctgcccggcaagaaccaccaatagtgtggtggaacttacggccctttccaaggccatggctcttttggcctgcacatgccagcccacgcatctccttgtgcttgtggactggtttggtgatccactgggtgtcaggatttcttccaatagctttatggaatggatcaatgaggataacctcaaaaaatttgtgtgtggaatcttcacccatccagtaagaattcaggactcttagagccccacagtggcgtccaactcactcctctgcaatcaactgtaggcttcagttaataccatgatggacaggcttgccgtaagttgcacccttaggaactgagcattttcggccatcacggagaatacgaatcccgtagataacataaccttgcttgatcttgtagcccagttggtgcactttatcgggccgggtggggcggggagccctgtggagagcagagagctggcggtactgccagcagcggaccctcagaagaaagctcatgacatcagactgcttcttcctccacagctcgtggatgtacttgtatgcacccatcttggcttacctgattgctgccgccagacagaagggccaaaaatcttaataatttttattttgaaaaatatatgcatgtggttagaaaaaacttcaaacagttcaaaagggtgaaaagcaactctccctcttgtacccagggagtacctggtaagatataacatctcatacaggacttacagaacctctataaaaactattaaaaaattttgttgagagacagtaaagaagacctaaataaatggagagatatacatgttcattgattggaagagcctagatttgaaggcgccaactcttgtattgattcatagatcaaatttaatcccaatgaaaagctcagcctttttttttttttttttttttttgcagaacttgacaatctgattccaaaactgataggggaataaaagggagtcaaactacccaagacactcttgggaggaaaaaacaaaaccaaaaatgaactgtgggctgggcgcagtggctcacgcctgtaatcccaacactttgggaggccgaggcaggtggatcatctgagatcaggagtttgagaccagcctggccaacatggtgaaaccccgtctctaataaaaatacaaaaattagctgggcatggtggtgggtgcctgtagtcccagctacttgggaggctgagggaagagaatcgcttgaacccaggaggcaatggttgcagtgagtcgagattgtgccactgcactccagcctggcaacagagcgagactccatctcaaagaaaaaaaaaagctagacatcaagttagggagaggaagacaaaccagaacccacattcctttttgacgctgttgtttacttttccattatagccattctagcacaattagagtaatatcttattgtggtctgttgaaatactttagaggaagttacacagatcatgatagattactttaaatgccatgccatatatctctaaaaatacacgtttatgtattggaagactcaatattgttaagatggcgatactactccaaagtgatctatagacttgatgtaatctctatgaaaatcccaatgtccttgtttgcagacctggaaaattcaaacctaaaattcacatggtatcgcacccaacagccaatcttgaaaaatgagcagagttggaagactcacacttggtgacttcagaatttactacaaagcaacaataatcgaaaagtttggtattggtaggaagataggcatatagattagtggaatagaatcgagagtctggaaataacccatacatctatggtcaattgttttgttttgttttgtttttttgacagagtctcaccctgtcacccaggctggagtgcaaaattatcacacctgtaagttccgaaattttttctcttattatttcatctacagctttttttcctgtgttttgtcagttttatttttctgaaatgcttattatttagatgtgggatctttttgtgtgaccttctaatgttctccattttctctgatctctgcaagatttcagcaatttctttcttcttcccttttctttttttacttcttgctttcttaatttctgagagctcctttttgttccctgaatgtttcttttaaaagatatactggtcgggtgcagtggcttacacccgtaataccagcactttgggaagccaataggaggatcgtttgaagccaggaatttcagagaagaattctgcaatctcctcattgaaggttgtggtagtcatacctgaccctgtgaataattctaaccaaggctgggcatggtagcttatgcctgtaaccccagcactttgggatgctgaggcaggtggatcacctgaagtcaggagtttgagaccagcctggccaacatggcgaaaccccatttctactaaaaatacaaaaattagctgggcatggcagtgcatgcctgtaatcccagctacttgggaggctgagggaggagaatcgcttgaacccggagctgagatcatgccattgcaccccagactgggcaacaaaagtgaaattccatctcaaaaagaaaataaaataaaaataaaaaaattctaaccaatgaggtatgattgaaaatgacacacgtctttgccaatcatacttcattggttagaattattattattatttgagacagagtctcactctgttgcccaggctggagtgcagtgttatgatctcggctcactgcagcctctgcctccctggatcaagagattcttctgtctcagcctcccaagtagctgggattacaggcatgcaccatcatgcccagttaattttttatacttttagtagaaatggggcttcactatgttggccaggcttgtcttggactcctcacctcaggttatccacctgccttggcctcccaaagtgctgggattacaggcgtgagccaacatgcctggcctggttagaattattcagagaataattgaacaattattctgtgaacaacctgtaaacgaacaacctgaaaattaaactaaggaaagaaaattaagacaatccacttgcaatagcaccaaaaacaataaaaatacttggtaataaatttaacaaaagatgttcaaaatttgtacactgaaagccatgaaacattgctgaaagacattaaggaagacctaaacaaatagaaaaacatcccatgtgcatggattagaagactcaatattgttaagatgtcaatactacccaaagcaatcaacagatttaatgcaatttcattggtcttttctgcagaagtggaaaggctgattctcaaattcacatggaattgtaaaagactccaaacagccacaacattcttgaaaaaaagaagaacaaagttggagggctcatatttcttgattttaaagcttactacaaagctacagtaatcaaaacagtgtggtattagcttaagaacagacatataaaccaatgaaatagaattgagagtccacaaataaacctatacaattatggtcaattgatttttgacaggtgtgctaagacaattcaatgggagaaagaatagccttttaaaaaaattgtcctaggaccactggataaacatgtacaaaaggatgaagttggaccctaaccttgcaattaccttaaaaattattataaatataagaactaaaactataaaactctcagaagaaaacacaaggatgaattttcatgatcttggacttggcaattaattcttagatatgacaccaaaagtacaagccaaaaaagaaaaatagacaaattagacttcatcaaattaaaaacttttgtgcattgaaggatattattaagaaagtaaaaagacaatgtacagaatgggagaaaatatgtgcacaccatgtatctgataaaagtctatgttttaatgtaattaaaacatgaacaaagttaatttgtgcggcagcaataaaaaagggaaacaaatatgaacaaaggacttgaatagacattcctagaagatacgtaaatcaccaacaggcacataaaaagatgttcaacatcattagtctttagagaaacacagacaaaaaccacagtgaggtctcaattcacacacactaggacagctacaatttttttttaaagtgtgtgtattggggggtgcagctgggaacagtgactcatgccagcactctgggatgccaaggcaggaggatcacttaagtccgggagtttgagaccagcctgggcgacatagcaagactgccatctctccaaaaaattaaaaaattagctgggagtggtggcacacccctgtggttctagctacttgggaaactgagtcgggaggattgaacccaggagtttgaggttgtagtgagctatgatcatgccactgcattctagccagagcaatagggtgagatcctatctctaaattacataaataaataaataagtaaatatgcagaaaataacaaatgctgacaggaatgtggagatattggaacactcatgcattgctggtggaaatgcaaaatggttcagctgctgagaaaaactgtttaatgattcgtcaaaaagttaaacacagaattaccatatatctcagcaattctactcctagaatattcacaaaataaatgaaaacatgcactcacatagatgcacatacacacatgtcgacagaggcactattcaccgcgccggacccaaaacatgtattttcttaggaacaccagatagcacttcagtgctatgcttgggggccatttcaaacagcaaaatcaataataaataccacagaaatgtgaaacctatggcacacaaatgctgcaaaaaggacatttgtggcctggcgcagtggctcacgcctgtaatctcagcacattgggaggccgaggtgggtggatcacctgaggtcaagagttcaagaccagcctgaccaatatggtgaaaccccgtcgctacaaaaaatacaaaaaatagctgggcgtggtggtgggcacgtgtaatcccagccactcgggaggctgagacaggaggattgctcaaacccaggaggcagaggttgcagtgagctgagatcgagccactgcactccaacctggaagacagagtgagactccatctcaaaaaaagaaaaaaaaaaaaaggacatttacaataggacagctgaaacaagaagtcagggtgtggcctcattcaacctcagataggaacatgtgtgttgagcaactcaaattttcttcttttttatttgagacgcagccttgctttgtcacccaggcccaggctgtcccaggcccaggcagtgacgtgatctcggctcactgcaacctctgcctcctgggttcaagtgattctcctgcttcggcctcttgagtagctgggattacaggcacccaccactatgcccaactaatttttgtatttttagtagagactgggtttcgccatgttggccaggctggtctcgaactcctgatctcaagtgatccgccagcctcagcctcccaaagtgctggggttacaggcgtgagccaccgcacccaacccttttttatttttattttcatttttttgagacagggttttgctctgtcacccagactggagtgcagtgatgccattgtggctcactgcagcgtcaacttcccaggctcaagtgatcctcccagcttccaaagtagctgggaccaaaggtgtgcaccaccacagctggctaattttttttgtctatttttggtagagacggggttttgccatgttgctcaggctggtctccaactgctgagctcaagtaatccacccacctcagcctctcaaagtgctggcattccaggtgtgagccatcacgaccagccagggatctcaccattcttaagtgcctctcattgaattctcctgttgatagttgcattgatttctcactccttcttctactctgtctcttgctacatctggaccctctctcattcattttctcaaagacattcatctagaatgtctaatttttgtggttgggatcaatacagttcacttgctttatggggtgggaggagtgtaacttttctttaaactgaattctaagcagttttcagttttaactcactacagtctccatgctatattctgaatgtttatatcccccaaaattcatatgttgaaatcctaacccctaaggtgatggtattaggaggtgagcctttgagagatgattaggtcttgacagtggagttctcatgactgggattagtgcccttataaaagggaccccaggctggatgtggtggctcacgcttgtaatggttcagctaccaaggcccccaaagtgttgagatcgcttgagcccagtggtttgagaccagcctgggcaacatagtgagacgacatctccacttaaaattgaaataataataaataaataaaaaggaccccagagagatcccctgccacttatcataggaaggcacagtgaaaagacagctatctagaaaagcaggtcctctccagacacttgaatctaccagcattttgatcttggacttcggtaccatgttacaacagccatacattgtgctactgatattccatatataattgacattttcagggttttttgttttgttttttgtttttttgttttttttttttttgagacaaaggctcgctctgtcgcccaggctggagtgcagtggcacgatcttggctcactgcaacctccgcctcccgggttcaagtgattatcctgcctcagcctgttgagtagctgggactacaggcatgcaccaccacgcgcagctaatttttgtatttttagtagagatggggttttgccattttggccaggctggtctcgaatgcctgacctcaagtgatctgcccaccttggcctcccaaagtgttgggattacaagagtgagccaccactgcacctggtctcttttctattcgttttgttttttgtttaaataaagacaggggtctccttatgttgcccaggctggtctggaactcctgacctcaagtgatctgcctccctcaccctcccaacgtgctgggattacaggcatgaggcactgaaactggcagaatttgaaggtgaggatttgggcttggcagggaaagtccacgcagagcagagctatgaggaagactgaagcccaagcccaaggtctctcatgacagttaggccatttttggtaaaagatctgaaagtctgaatttggggatcctgtaaataaaacgttcatgggtagggctgaatccaggatgcaaatgaagccatcatgagtctgtttttctccctttcttgacttctgcttgccgtttgttggccccagcctcaggcttcatgtagcagggacacgatggatgtcattcaggtacctgggtcccctcagacttccagtgagaggagtcagaagcaagactctctttccccatattctttttttttttttaaagacgaagtctcactctgttgccccaggctggagtgcattgacaccatctgggctcgctgcaacctctgcctcctgggttcaagcgattctcatgcctcagcctcccgagtagctgggattacaggcatgcgctagcacgtccggctaatttttgtatttttaatagagacggggtttcatcatgttggccaggctggtctggagctcctgacctcaggtgatctgctcgccttggcctcccaaagtgctgggattacaggcgtgagccaccgcacctggcttctttccccagattcttagcccaaattacattgtgactcttgggctgtgactaggtcacatgatctctttgaaccaatcactgtgtccagatgaatgcaatgcactcattgtctaaggctgggaacacattttgggcacagggaatggcctttcaaaactgtacatcaaatcatgtccctttccagtctgaggtcctatccagcaatgattctcaaccaggtcgagtttgccctcccaggggacatttggcaacgtagggaggcatttttggttgtcacaacgtcagggtgtgtgtgcaggtacattcctggcatttggtgggtaggggccaggaatgaggctaaaacatcctgcaatgggtcaggtatgttggctcaaacctgtaattccggagctttgggaagccgcggcaggaggattgcttgagcccaggagtttgacaccagcctgggcaaaatgacaaaacaccatatctacaaagaaaaatacaaaaattagctaggcatggtggcacgtgcctgtggtcccagctactaggaaggttgaggcaagaagatcccttgatcccaggagtatgaggctgtcgtgagctctgatcatgccatgccactccagcctgggtgacagagggaaaccctgtctcaaagaaacaaacaaacaaacaggccaagcatggtggctcacacctgtaatcgcagcactttgggagcctgaggcaggcagatcgcttgagccaggaggattgcttgagcccaggagttcgaggctgcagtgagctatgatcacaccactgcactctgcactccagcatgaacaacagagcaagaccttctccagaaaaaaataaaacccctcaaaaccagacaaagatatctgcaaagataacaggaaataatatttctcccaaggacactgcagctgtcaagtgccatggtgacttcctactgtgaaccactgctttctgacttgctgagaaactttgttccaggaaatcatagataatttgcagtttgaaaatatatcagtgcaggccgggtgcagtggctcacgcctgtaatcccagcactttgggaggccaaggcaggtggatcacctgaggtcaggagttcgagaccagcctgaccaacatggtgaaacccccgtctctactaaaaacacttaagttagccaggcatggtggcgggtgcctgtaattgcagctacttgggaggctgaggcagaactgcttgaccctgggaggtagaggttgcagtgaactgagatcgtgccattgtacttcagtctgggcgacaagaccaaaactctgtctcaaaaaaaaaaaaaaaaaaaaaaaagaaaagaaaaaagaaaagaaaagaaaatatgtcagtacaaatgaaattttttcttcttgcttggaggatctgggcagttggatacccaggcacagcaattcagataagggttccctgaacaaagtggtccacatttactaaactttagaagttaatttttgcctttgtttggtgaagcaacccacagctgctcagttgctctggtgtccctctccctccttttttttttttttttttttttgagacagggtctcactctgttgcccaggctgcagtgcagtggtgcaatcacagctcagtagaacctctacctcctgggctcaagcaatcctcccacctcagcctcccgagtagctgggaatacaggcatgtaccaccatgcttggctaatttttgtattgtttgtggagatggggttttgccatgttgccccagctggtcttgaactcctagcttcaagtgatcccccagcctcggcctcccaaagtgctgggattataggcgtgagccaccatccagcctttccttgttttcaataaatgaataaacctgactttctcactaaaggttagtccctggtggccaggctggtctcgaactcctgggctcaagcaatcctcccacctcggcctctcaaagtgctgggattatatgtgtgagccatcacgctcagcctcatttatgtatttgttatggctgcctttgcactcccatgatagatgtgagaaatggtggcagagactgcagggcctgcaaagcctaaaaaatttacaatctggctctttacagaaaaactttgctgacccctggtctaaatgttctgagtacataagtgagcaaaacatagctaaatccctccatcatggagctgaaattctagtgggaaaaagaaaaggatttacatacttacaagacaccataaatacatctagtatatgacttgtatataacttagggtaattaaatggtaagaaaagaagtggccgggcatggtggctcacacctgtaatcccagcactttggggggccgaggtgggcgggtcacctgaggccaggagttcaagaccagcctggccaacatggcaaaaccctatctctactaaaaatacaaaaattagctgggcgtggtggtgccaacccgtaatcccagctgctcgggaagctaaggtgggaggaagcaccatgcccggcctgcttccactttttggctactgtgaataatgctgttgtgaacatgggtgtacaaatatctgttcaaacccctgctttcactacttctttttttttttttttgagacggagtttcactcttgatgcccaggctggagtgcaatggtgcaatcttggctcaccacaacctctgcctcctgggttcaagcgattctcctgcctcagcctcctgagtatctgggattacaggcacgcgccactgtgcccggctaattttatatttttagtagagagaggatttctccttgttggtcaggttggtctcgaactcatgacttcaggtaatgcacctgcttcgggatcccaaagtgctgggattacagacgtgagccactgcgcccggcctctcttattttggttatatacctagaagtagaattgttgtatttttttccagcaggattttataccaaggacaaagggaggccatgggaagctgcatgcagggtgctttactaggtcccctggggctgctgtgaggcattctgattgtagtggggaaagaaaggaagtggggagaccaaggaggaggtaggtacagaagttcaggtcacaggtagcagcagcttcaaggtcccaatctgggccaggcgctcacgcctgtaatcctagcactttgggaggccaaggcgggcggatcacttgaggtcaggagttcaagaccagcctggccaacatggtgaaaccccgtctctaccaaaaatacaaaaattggctgggcgtggtggtgtgtgcctgtagtcccagctacttaagagactgaggcaggagaatcgcttgaacctgggagatgcaggttgcggcgagccaagatcctgccactgcactccagcctgggcgacagagcgagactctatcttaaaaaaaaataaaaataaaattaaaaaaatgctctcagtctggcaggggaggccatatggagcaaataaataaatgaatgattacaaatagtgaaaagtactcctaaataaatgaacaagaacagagtgctgtgattacaggaaataaaaagaggaactctggcattctctgtgctacctatcagtttagtgatgcttgaaatccaaaattcaaatcttgcattttaatcatgaatcactttgctgccagttgagtgggtttgatgcagggccgagtctgttggtctaagggtttgttacattgtgagagcccctaatggggaggaaggggcttagaaataaggcaaagggggtggtttgagcctgtggctgaaagagttgcacagagaggcttggtggttaggagcagagctgagccttatctctgccacatcccagctgctggatctgcaacaaattacttcttccctctaaacccagtttccgcttttggaaaatggtagactaattggtttggtctataattacttccttctttgttttggtcactcctgtgtctacagcacctaatacagtatccggcacacaggagactcgcaataaatttctttcttgcttttctttctttccttgtctttccctccttccctccctcccttctttctttctcgctgtctgtctttctcgctctttctctttctttctttctctctctctcttttctttctttctctctctctctttctttcctttcttgatggagtctcactctgtctctgagactggagtgcagtggcgccatctcggctcacctcaacctctgcctcctgggttcaagtgattctcctgcctccacctcctgagtagcttggattacaggcatgcgccaccatgcctggctaatttttgtatttttagtagagacggtgtttcaccatattggtcaggctggtcttgaactcctgacctcaggtgatccacccgcttcggcctcccagagtgttgggattacaggcgtgagccaccgtgcccgactctcgtttatttattttctattttaaaaattttaattgaggctgcgcacagtggctcatgcctgtaatcccagcgctttgggaggctaaggcaggagggtcgcctgcggccaggagttcaagaccaacttgggtaacgtagtgagatcccattttacataaatattgcaaaaaatgttagtcaggcgtggtggtgtcccccatagtcacagctacttggggggctaaggcaggaagattgcttgagtccaagagtttgaggctacagtgagcacccactgctctctagcctgaagaacagagcaagagcaagatcatagctcaaaaaaatttttttaattgagtttaactttcatagagcaaagtacagcaactttaaatgtcctcttgatgaagttttttttttttttttgagacggagtctcactctgttgcccaggctggagtgccgtggcacgatctcggctcactgcaatctctgcctcctgggttcaagtgattctcctgctgcagcctccagagtagctggcattacaggcatgcaccaggacacctaatttatgtatttttagtagagatgcgggtctgccatgttggccaggctggtcttgaactcctgacctcaagtgatccacccaccttggcttcccaaagtgatgggtgggattacaggcatgagccactgcacctagccaagctcaatgaattttaaaatataaatgtgtgtgtacgtgtgtgtgtgtgtgtgtgtgtgtgtgtatatatatatatatatatatatatgtttaaaaccacataactaccaccaaatcaagttatagaacatttacatctccctaggacatttcttcctatcttgactttgatcaacatatgttgttgttattattattattattattattattattattattattattcagagacagggtctacctctgttgcccaggctggagtgcagtgttgcaatcgtacacaattcaccgcagtctggaactctggggctcaagcaattctcctatctcagtttcctgagtagctaggaccacaggtgtgtgccaatatgcccagctaatctttaaaattgttttgttgaggcaggcatggtggctcacgcctgtaaccccagcactttgggaggccgaggcaggtggatcacaaggtcaggagtttgagaccagcctggccaacatggtgaaacgccgtctctactaaagatacaaaaaaattagccaggcaccgtggcacgcacctgtaatcccagctacttgggaaactggggcaggagaatcacttgaacccggaaggcagaggttgcagtgagctgagatcatgcctccgcactccaacctgggccaaagggagagagtctgtctcaaaaaataaaaaaaaaaaagaaatttgttttgtagaaatgaggtctcactatgttgcccaggctggtctcaaacttctggcctgatgagcaatccgcctgcctgggcctcccagattgctggtattacagacatgagccacagtgcctggctcttgaataatgtatattagttttgcctattgttgaacatcgtgtaaatgagatcatggcaaatatgctcttttgtgtctgccttgttttgctccttgttgtgttttgtgggattcatacatattgttgctattatgaacattttttgtagatgtgttttggtggatgtaagctcacctttcttttggaggcgagtggaatttctgtgtcactatgtaattgtatgtttcactttagcacgaattattagttttctttcttttttggagatggagtctcactctgtcacctaggctggagtgaagtggtgcgatcttggctcagagcaacctgtgcctcctgggttcaagtgagtgttgtgcctcagctccccaagtagctgagactataggcatgtgccacaacgcccagctaattttattttattttattttacttttgagacagagtctcactctgtcgcccaggctggagcgcggtggcgcgatcttagctcactgcaacctgcgcctcccaggttcaagcagttctcctgccttagcctcccgagtagctcggattacaggcatgtgccaccatgcctggctaatttttttgtattgttaatagagatggggtttcctcatgtcagccaggctggtcttgaactcctgagctcaggcaatccacccaccttggcccacctttttgtattttttgtagagatggggtttcaccatgttgctcaggctggtctcaatctcctgagctcaagagatccacctgcctcggccacccaaagtgctgggattacaggcatgagccactgcacccagccaaattgttagttttccaaagtagttaagccaatttatatacctcccaacagagcgtgccttttccagttaatccacgtctttgtctgcactcgtaattttcagtctttgtttccagtcactctggtgggtgtatgatggtatttcactggggttttatttgcatttccctgatgactaatgaagttgagcatgttttcatgtgcttgctcaataaatatttgttgaaaggatgaataaagagtgaatgaataaaacatggaaagaaatccaactctgtcttgtgccctgcctaaaacccaccagtggttcccactgcccctcctttggccgacgggtacctgcctgccctggctccttctgaccccacctgctccggatggatttcttttgcttcttctctgggttcctgccatccaggctgtcttcagtttcctccaaggaccctccctgcttcataactttgctataaactgttttcttctgcccagaacacaacccaggcccaaggaacccagacgcgttccttgtatctcagtttgaaagcctcttcctccaggaagccttctctgacttccaccccccagcaagggtggtataaattgctaacttaggcccacttttgcccactttttttgtttgtgtttttgagatggagtcacactttgtcgtccaggctggagtgcagtggggccatctcagctcactgcaacctccatctcctgggttcaagtgattctcctgccttagcttcctgaatagctgggattacaggcacccaccaccatgtccagctaatttttgtatttttacatttatttatttatttatttgagatagagtattgctttgtcgcccaggctggagtgcagtggcatgatcttggcttactgcaacctccgcctcccaggttcaagtgattctcctgcctcagcctcccgagtagctgagcctgcaggtgcctgccaccacacccagctaatttttgtatttttagtagagatggggttttaccatcggtcagactggtctcgaactcctgaccttaagtgatctgcctgccttggcctcccaaagtgctgggattacaggcgtgagccaccatgcccggccaccactttttttttctagctgtgaccatagttgtacatatctccccttccctggcttttttttttgttttttttttcctgagacaggatctcgctgtgttacccaggctgcagtgcagcggtgcaatcatagctcactgtagccttgaactcctgggccaaatgagcctcccacctcggcctcccaaagcactgagattacatgcgtgagtcactacttctggcctgtaaataccctttcaaaaatataatatttgattaacatctgccatcttaccataagaaacacttaaaaaaatcccaatccaaaaaaattccaatcctttaagctatataagagtagcaattttatcttgttcctagcaagacatctggcatatagtaaatgctcaataaatatttgttgacagtataaaggtcaagcaacagcataactggcattattacatgaaagtaattatcccttagaaactcattcacccttgggggacccgggccaataaaaaaatcacagaaaacaatcctatctaccttcctccttcctccttccctcgctaggtcctttgattggggggaggtctcaaatgcacacactgtttctgttttatttggtgcagctgttgtgtgcatgtgttatggaaacccacatcaggcaggagattaaggaggagaggagaaaagaaaggcatcgctggtatcacagtgaaatttacactctgcggcctcgccctagctcctctgtctctacctgtctgcctatgaaacagttcaaaactaatatggcgcaatggatggtattatagacttcccacctccctggccagacttcttgggttcaaagtttggcttaatcacttaccatctaaataatccctgacaatgtactctgtctttctgggccttagtggcctcatctgcaaaatggggataatactacttcttacctcatggggttgtgaggattgcacaagttaatttgtgtaaattgctaagaacacagccttaggaagccttgtcactgtgaatgcatattaattttttttattattattttttgagacagagtcttgctctgttgcccaggctggagtgcagtggtgtgatctaagctcatttcaacctccgcctcccaggttcaagtgattctcctgtttcagcttctcaagtagctgggactacaggtgcccgccaccatgcccggctaatttttgtgtttttagtagagacagggttttgctatgttggctaggctggtcttgaactcctgaccttatgtgatcggcccgcctcggcttcccaaagtgcttgattacaagcacgagccaccatgcctggcctacgattatcatgtctccaggcttcagtttccttacctctgaggtgaggatcaataacctggttatttctaagtgatgcttaaagaggttgagaagaagcaaaggcgctctgcacacaggtgaggtcaacagctgttagtgatggagactggcgccgtctgggtcatcagtgctccggaatcaggctgctcacgggtttgaatctcacttccactttcactccttattaactgtgtgacctcgggcaagtcacttcgcctttctgaacctcagtttccccatctgtaaaaggtaggtgaataacagtattcacctccttctgtgtgactcagctttggagtcagcggaccgggttcaaatcccagccctgcaagtgattagccaggtgaccctgggcagagggaatcactcaacctctctgcacctgggtttcttccttcatgaacgtggagactttacaggatgaaatgagggcacagttaaggcgcccggtacactccaggcaggtagggggctccgttcacgttattttcccctggtgacggatactgtccttaaacagcatttgaaaagtggtcgcagggtgtgtggccccaaagatcccaggcgcttccggaaggcgagccaacgctccccaggcccgtccgcgagcgggtgggcctaagccttggaggatctggggtgggggtggcgcggggtccaggcccggggcgccgagaggtggctggtccggctgcccacgccgagacgcgcgaggtgagcgggcgccggggcggggcggggtggggcggggccgccgcatccccgtgacgcgcgggccaaccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggtacgtgccgggggccgcgtgaggccggcgggacggagggaggccggcggggagggaaagcaccgggcccgcagccgcccggggcaccccgctccccgctctgctgccggcctcgggggcccgggaccctcacgtcgcccgcggcccagcccctttcgggggtgcaaggcatgggggaaacttgggtgactcagttcctgcggagcagagcgtggggggccgcgtgcccagccctggggttttggagggtcgggtcgggtcagagccgccgtgaggaggccttcctgttttggggttcccgtctgtaaaaacaaccttccagggaaggggacgctagagatggggggcgggaagaggggtgtctctctgcttctgttttcccatcttttttgtggttagggtccccccttttcacgaaaaatactccgtgaccaacggggtgagctggggaggggcttagattgtagaaagggactttcattgtctccccaaagttgtcgtacaagccacattactcttctgtggttacctagctttgttttttttgttctttctacttagatactgcgggggaagtttgggggaaccagggaagaagggggatgtccacccttgatgtgccctacctgaccctcggctcggggcagacttggggtgcagctgaggacgcccaggaccctggtagctgtggtcctgccctcccttccctgcaacacgtggagctcctctctggggatgccccttagatttaaccccggcaagttttcttctgtaacgtggcctgcggagcctgactgggtgtctggagtccacttgctgtggtttaagccccagtcttttgggcttcagcttctccgtaatgcgatttgcctctttgttccaggaaggcaggcacttctgtctcgtgctgtcttgattgttggtgaacgcagtaggcaaatctggacacgactgtttctctctcctcttttgtttaggaatcaggagaaacagccttggttcttaggagctggtgatcagcttccaaaaatactttcttgtcctgttttgccggcctttcctcgagggttgcatttggagtgttgaaaagtcatcctccagggccccattggagggtttggttttgtttgtttgttttttttagtagggtatcattgtgtttaataacctaccacactttgatatatctcccattttaagccagtggggttggagagtaaccccaggggtggaaatagaacacagactttgccttgagggtctgggggtgattggagcctctttgcagatggactttctttagcaggggaaaacctgtggcttccttgttgccaggtgtagtaacagcaagattattttttgcaaagattcacatggtgatctgggtttgtgttgctgtgaattccagaatattctcttgtttattttcttctgaattgaggagggggcaaaacagggtgaacatccatgaggttttgtatcaggacgtattttattgatggcaattggtagttgatggctaatgagtatgtttggggtgcgctttgtttatcttaagaaactcattcacgaagtccagttgtaatattttttaaaatttttattttcttttttctttttattttttccttcgttaaggactttctgccacagaaattgccaggtggttgggttttgcttgggggtaattgtagctgatctctgcctctggtaggtaccccatccccgtgtttgaccttgcgtatttctgctgtctggattccaagacttgttggaggtgccttggaaccagaatttgagaggaggcaactggggcctgagtgggaaaattgaaatataattaactgaaagctagaaagtaggtagttgttgcttttttcttttcttttttttttctttttcttttttgagacagagtcttgctctgtcacccaggctggagtgcagtggcacgatctcagcttactgcaatctctgcctccccggctcaagtggtcctcctaactcagcctcccaagtacctgggactataggcgtgtgccaccacgcccagctaatttttgtattttttatagagacagattcgcactatattgcccaggctggtctcctactcctgggctcaagcgatcctcctgccttggcctccaaaagtgttgagattacaggcatgggcctctgtgcccggctgtttttgtgtttttcaaggtagcgtgtccgaggccaggagcgactggcctcccaggcagtcagataactgtgtgaccttgagcaagccactttccctctgtgtgcctcactttcctcatctctaaaattggacaggagccaaaaatgtggcagccttcttgggttgttgcgaagggtcaatgagttaatcttgtaagtggctcagcttgtgccctgcacggagataaacaatggttagtattaaatattattttttccaaagatgaagttgtgtgttttaagctccttgttcttcctttggattccccttttcttcagctggtggagatgggattgggctgtgaaaaggcagtgaggcacccgtgcctggctcctgttgtgaccaaggtcatgtgcttagaagtcaaggtcagtgggcctcgggtgactctgtcagagctttgtttctgggctactgtctgcctctgagccgcaggaaatgtccagaaaacccagaagatggaaatggcccatgataagtgttctgttgacctttactcagacagatgctctgggaagagaaaaggagaactttgctatcaaaacggaaaatagggcctgaggacaggtcacagcagcccttggctttcttttctcatgggggtgggactggtaggaggcgctgctttgtggttgatattggcatgatggttggaaaaatgggcctgggactttttgtgagttcattaaaaaaaaaaaaaaaaaaaaaaaaaaaagcaggccgggtgcagtggctcacgcctgtaatcccagcactttgggaggctgaggcaggcggattgcttgaggtcaggagttcgagaccagcctaggcaacatggattgacccccgtctctactaataataccaaaaaaaaaaaaaaagcctggcatggtggtgtggcacctgtggtcccggctactagggaggctgaggcactagaatcacttgaaggctgtgggggtggaggttgcaatgagctgagatcacggtcactgcactccagtctgggccacagactgagaccctgtctcaaaaaaaagagggccgggtgtagtagatcatgcctgtaatcccagcactttgggaggccaaggcaggcggatcacctgaggtcaggggttcaagaccagcctgaccaacatggcaaaaccccatccctactaaaaatacaaaaattagctgggcctggtgattcacgcctgtaattccagctacttgggaggctgaggcaggagaattgcttgaacctgggaagaggttgcagtgagctgagatcacatcactgcactccaacctgggcgacagagagactgtctcaaaagaaaaaaaaaattgtgcttcaggccctgtgtagaaaaattggaaattatggaaaagcagaggaaacaacttggtattaagcagtatagtgtggtggctcagagcaaattcgcctctgctgctgaggcaggttacgtcatctctccgtgcctcagtttccctatgtgggataacgtagtacctagtgaatagcggtgacttgaggaataagtgagttaatccttagcaaggacttaaaatgttgctgcttggcacacagcgctcagtaaagatcagtggtcgttgccacctggaattctccagttaatttttgctgttgcaccaactgccactggagaagaccagaaggaagctgcaggtgtgtgtcaccgtcgatggagtgagctggtcccagggttgatgtgcacctctgagatgctctgtggcatccaccaactcagtaaccccctgaatatctgacttagccgccaaggaagaatatcttagaagctattaggaattcctcttggggctaggtctgggccttggagtcagtctgatccctggtttaattcttccccttggctcaacagcagtgtacgacgagccaatttttcccctcctccaagtgtggctttggttttcaaatccatcccttagccttctcctacttcctctgttttcccctccccaccctttttttttttttttttttgagatggtgtcttgctgtgtcgcccaggctagggtgcagtggtgtgatctcggttcactacaacctctgcctgctgcgttcacatgattcccctgcctcaggctcccgagtagctgggattacaggcgcacagccaccatgcctggctaagttttgtatttttacaaaactttacaaaacccccatagagacggggtttcatcatgttggccaggctggtcttgaactcctgacctcaagtggtcaacctgcctcagcctcccaaagtgttggggattgcaagcgtgagccaccgcgctcagcctgttttccccctttttggctgcccctccttccagacccttcctctctcccttccttatggagtgttagagtggaaagggatgtcagatcttggggggccctcctctccacccaccccatttcgtggatgtggacactgaggtccaggatggtgacatgacagggtgcaaggtggcaaggtgaatggctttgggaggagatgagggtgacccgggagaggcctgggcaggagtggactcaggggttcctggtccaaatgggttcgtgattcaggccaatcaggagcggattcagggttccttggccaaatggagccactgcagccacaggggccctgcagaaggcagctgcagccggtccctttggccaagactctcctgaagggtcgtgttctctttctccgaggacaagttccatttgtgatagcctggagggggtgcctcgcctttgggacctggtggtagatgggggggaagaaaaccttttctgtttgtggacacaacttttaggaactgatctctctatgtgggtgtctcccactgaccatgttcctaaagaacgtgagcttcctcttcccatgtcagtctccagctttgacttctctttttctcctcccattcctatcacatctgtcagcaaatcgtgttgcccgttgcctcaaacgggctgcttttcatggcttccccgacttccactctggctcgagtcatcgttggccagtttctggatttgaacagtcacctcagtccaggcgccgtggctcatgcctgtaatcctggcacttcgggaggccaaggcagacggatcatttgaggccaggagtttgagaccagtctgggcagaatggtgaaaacctgtctcaactaaaaatacaaaaattagccgagcctggtggtgggcgcctgtaatcccagctacttgggaggctgaggcaggagaatcgcttgagcccagtggggttggaggttgcagtgagccgagagttcgccactgcgctccagcctgggtgacagtgagactctgtctcaaaaaaaaagaaaacagccacctgttcgctgctgtgcctactctgcccttgacccctacagtctagtcttggcccagctgtccctcttctactaaaaccctgcagtagttccttgagggtacaagccaaagggcttacagtggcctcgaaggctgggcagcatctgtccccttggcctccctgacctcttctctggctgctttctgtctcactctcctccagccacacttgtggccaggcctgtccctgcctcagggcctttgcacttgctgtttctcctacctactatgtccctcaccttcaaactttgttcaggtgtcacctcaggcatcccgttctttccctccactagcaaatctctgtcccccatctacacccccagtagcacttactgccttctaatacacgtaatattttgcttaagtattgtgcctactctgtaaactcctaccaaaagatcggctccataggggcagggattttggcctgtgtttgtttacggctgtaatcccagcacctagaactgtgcctggggcttagtaaataacagttgaccttggaacaattcaggggttaggagtgctgatgccccatgtagttgaaaatttaggatgcagcgcggtggcttacacctgtaatctcagcactttgggaggccgaggcaggtggattacctgaggtcaggagttccagactagtctggccaacatggtgaaagcccatctctacaaaaattagccaggtgtggtggctcatgcctgtaatctcagcactttgggaggccaaggcaggcagatcacttgaggtcaggagtttgagaccagcctggccaacatggtaaaaccctgtctctacaaaaattagctgggtgtggtggcgggtgcctgtaatcccagctacttgagaagctgaggcatgagcattgcttgaacctggtaggcggacactgcagtgagccgagatcgcgccattgcactccagcttgggtgacagagtaagactctgtctaaaaaaaaaaaaacacaataaaggaaagaaaattcaggtctaactttcaactccctaaaagtttaactactaacagcttactgttgactggaagccttaccgagaacataagcagttgataacactaattctgttgttgttggttgttttttgatagagatggggagcttgctgtgttgccgaggctggtctcaaactcctggcctcaagctattcacctgcctcggcctcctaaagtgctgggattataggcgtgagccactgcacttggcctaactcataccttgtatatatattatatactgtatttttacagtgaagcaaggtagagaaaagaaaatgttaagattaattcataagagagatttttactatttattaagtggaagtggatcatcataaaggtcttcatcttcattgtcttcacgttgaggaggctaaggaggaggaggaaggggaggggttggtcttgctatctcagggatggcagaggcagaagcataatctgagtataagtggacccgtgcagtttaaatgtgtgttgttcaagggtcagctgtttgttgaataaatgaatgacatgaagtattacagtggcttttgggcggtgtcgaaacttctttgtaaggattttaaggatgaaataatcacttaactgtctggaatgaacactcagataaactgagtcctccagctttctcatcagatggcttgtttttttattttatttttttgagacagggtcttgctctgtcacccaggctggagtgcagtggcgcgacctcagctcactgcagcctcaacctcctgagctcaagcaattctcccacttcagctccccaggtagctgggactacaggcacacaccaccatgcccagctaattttttttttttttttttttgtagagatagggttttgccatgttgctcaggttggtggtgaactcctgaactcaggcgatctgcctgccttggcctcccaaagtgctgggattataggtgtgagccaccgtgcttggcagaacagcttctatttcatcttggaaaggtcagaacagggttttgtccacccctcttttcccaggactcagtgtctcacacacagtgggggctcaatcaacattagaatttgagtgtttgaggtatgagttccaagctaggggttagatatagctcaccactgtgctggtttggcttgattttaattataggaatgactgtgatttccaattttatttatttatttatttgagacggagtcttgctctgttgccaggctggagtgcagtggcacgatcttggctcactgcaacctctgcctcctgggttcaagcaattctgcctcagcctccccagtagctgggactacaggggcacgccaccacatccagctaatttttgtgtttttgatagaaacggggtttccagtatgttggccagcatggcctcgatctcttgacctcgtgatccgcccgcctcggcctcctaaagtgctgggattacaggcatgagccactgtggcccgccctacaatgtttattcattggcagatttcacagaaacatctggatttctggcttcccttgaaaaatcagaagttctgctagccccaggcccacatttatacatggtagcggtccgctgaggctgtccgtttctgagttgctccagtttgccgcagtccccacccctccctgttgttgctttaattttaaggccaaatgtttgttgcctttgttttattttatattatttttttgagacgaagtctcgctctgtcacccaggctggagtgcagtagtggaatctcggctcactgcaacctctgcctcccgggttccagtgattctgctgcctcagcttcccgagtagctgggattacaggcccgcaccaccacactcggcttatttttgtatttttagtagagatggggtttctccatattggccaggctggtcttgaattcctgaactcaagtggatcacttgagttcctcagcctcccaaagtgctgggattacaggcatgagccaccgtgcctggcctgttgcctttttaaaattgtgcttcctcacacctggtctgcttcttgcatggatggaacccactttggcacctgttggtatctgagttggcatctcctgctttgcaggccaaccttgaagttagcatctgattggtatgttggcttcagattttcatggcgaagtaaggcctagctttgatgatcagctcttagtgtggtcagtacaactctagctcgtgaaaacttgcccaaacattttgccaaaattaattaatggccagacatcctgaggcaagcttccccccgcttagcaagaaaactgggatagggcagcatccctgtgggtggagtggtgctggggacctgcacttacctcttagaggctgaatggttgaacggggcctttgaggaagctgtattttgcgggtggggacatggagcacagttgctcagtgtcggccccgttgacatgtaggccacatcattctttgtggcctggttgctgttctgtgcagcgtagtcttagccccaaacctggcctctaccccctagtagatgctggtagcacctcctcttgttgtgacaaccgaaaatgcctctagatgtttccatatgttccctggggtgtgaaatcacacagccactggtgtggaggaatatgggggagaaacatggagcaagaccttcctcctcatcctgcatttccctaggaggttgtgggctgtcgaaattctagtgtaattggcttactggggttgccttggagaagcttaatgagacgttaaggaggttaaactccaattagctagagaagaaacttgcggcagtttcttttttactgagggctgtgtctttttacctttttccattttcccagttggagttgtgacagttcattctcccctgggaaaacaaaaatggctttctttttctttttctttcttttttcttttgagacagggtctccctctgtcacccaggctggagtgcagtggcacaatcatagctcactgcagcctcgacctcctgggctgaagctatcttcccaccttagcctcccaggtagctgggaccagaggtgcacaccaccatacccggctaatttttgtattttttgtagagtcagggtctcaccatgttgcccaggcttgtctcaaactcctgggctcaagcgatcctcctgcctcggcctcccaaagtgctgggattacaggcgtgagccaccatgcccagccgaaaatggctttcttgagagatcagctttgaagctctactccttcattttaaagtgccccaggagaagtggacgattacaaagttgagattccacttaagtgtccccttagtttaactgtgggattcatctcctggggaggttgccaggttctggaaagtgggtgttaatgaccagggagggtgcccctaggctagcatcctgtaaccctcaggaattgagatttttatggaggttttctcttcctctctgtgagttttctctctgagaaacctgtctagggagggaggctctaggctagcatcctgtaaccctcaagtagtaattgagatttttatggagcttttatcttcctctctgtgagttttctctctgaggaacctcagtgtaccttttactggcctcctaggtaatacttgtttggagaatatgtgtgatgtctaagtcttcccagtacaagaaatttgtgtggtgtttgactgattgatggatggagtcttgttctgtcgccctagctgattgtaccactgcactgcagtctcgacctcccaggccaagtgaccctcccaactcaccctcccaagtagctgggactacaggcatgcaccagcacacccggctaatttttgtatttttttttgtagagatggggtttcactatgttgcccagtttggtcttgaactcttgagctcaagcagtctcccagagtgctgggattacaggtgtgagccaccacgcccagcctcgtgtggtctttgatacccctgggttcattgtattgttcttcccacactgcttttcattcattcatttattcagtcattattaattgagcagctactatgtgctgctgctgctctaggcactgaggatacaacagtgaacaggacagaccaggcccatgttctcatggggtttacactgagggtgacggaaatgatttcagatgctggcaagtgctgcaaagacttgaaccgggaaaaactgggtgaggtgcaaactactacggagggatgtccacagaaggcctttcggaggcggtgaggtttgaccccagagctcagtggcaaagctggccatgcaaggatgtgggggaagggagtcccagagtgggaagagaatgtgcataggccttgaggaagatcatggtgtggttaaagtattgaggagtttaactcaaaggaactgcagagcccatctcataaaaatctagcctggagcattcggcaaaatgcataaagcactaacacaatggcttgtggtcctggaatttccagggaaggcgcttaccagctcagcaaggaagtagaacaatgcatggtccctggcagaagcaagaaccttctgatctgtttatgtttgaatgaaacgcaggttttttttttttttttttttttttaaaatagatgggggtcttgctatgctgctcaggctggtctcgaactcctgggctcaagcaatccacccaccttggcccttccatgtgctgggattacaggcatgaggcactacgccctgctgaatctcaggtcttaaaaattcagtttattttgttttatgagtctcttctctttctcagaaccttaactgaaacgtttgtgatcaagaccaacttgggtttccccactccccagttgcctttgattctccgccaaaggcttgttcgtaagatgatgaggtacttttttcctgtggttaagaggactttctataggttgctagaaaactcttgttttaaaacaagatgttgttgaattgatctggctgattgcaggaggaagatcttgtactgcaactttgttgatgatgctaatactttaaggtgaatattctagaagaatataaagggaaaaataaaagttttagtatgttcccaccctgccctttgttcccagaagtagccgttattgatgatggttgttgatgatagtttcttgggtgtttttcgagaaaagtttcaagtatatgcaaatgtatgtgcaagaacgtgttcgtttgtgtgtatatgtttacatattcattttttccctccctagttgggtattttaaatactgttttgtctcttgttctcttcacttaaccagtgttgattttcttgccattttaagcccatgcaaattgaaagtaaaagccaatcaaatcaacttttttttttttttttttttaaacaagccacgcatttgcctgttaaatggctgagccatgtattcacccattcccctcttggtgtctatcaaggtcattcccagttcctggtttcttgctgtgataagcagtgctgcactgaaggcacatgtatgcaaatatatgtaaatgattcagcagaataaattttcccacaggaaattgctaggttgacagtatgtgcattttgaaatttgatagttaattgtcaggttactgcagcagtttatactcccactaatgggcccaccagcacttattaagcacctgttgttttcctgccatatcagaaaaattgagcaagctgggaagtgatcaggcccatgttgcttggctgtgtgtgagagggctttgcccagttaagttaaaccttactttccagaggtcaggagatcaaagcagaagtgtgctttggttttgttcagttttttaaaagatgtgtttaaattttaaacatctttggacttattttaaaaattgcttttaaatcaataatttaacaatgtgtaaaaacattactgatagtctcaccatgctaatgtcactctgatttttacacctaaactaatttaattgcagagttttctgatcacaagtgacatgtgttccatatgacagaacaaacaatacaaagatatttaaataaagcctgaacatggtactgatattagtttgttcatgctgctatgaaaaaatacctgagactgcgtagtttataaaggaaagaggtttaattgactcacagttctgcatggctggggaggcctcaggaaacttaaaatgatggtggaaaggaaagcaaacatgtccttcttcacatggtggcaggagacagaagtgcagagtaaagaggagaaaagccggtataaaaccatcagatcttctgaggactcactatcaggagaacagcatgggggaaccgctcccatgatctaatcacctccagtgaggtccctccaccaacacgtggggattacaattaagattacaattcaagatgagatttgtgcggggacacagagccgtgccatatcattctgcccctggcccctcccaaatctcatctttctcatatttcaaaacacaattatgccttcccaacagttccccaaagtcttaactcatttcagcattaactcaaaagtctatgtccaaaatctcatctgagacaaaatctagtctctttcacctatcagcctgtaaaatcaaaagaagttagttagttcctagatacaatgggggtacaggcattggataaatacacccgtttgaaatgggagaaattggccaaaacaaaggggctgcaggccccatgcaagtctgaaatccaataggccagtcataaaactttcaagttccatagttatctcctttgactccgtgtctcacatccaggtcacactgttgcaagaggtgggcttccacggccttgggcagctctgcccctgtggctttgcagggtatagccccgctcctggctgctttcacaggttggcgttgagtgtctccgtcttttccaggcacacgatgtagctgcaggtggatctaccattctgggttctggatggtggcccttttctcacagctccattaggcagtaccccagtggggactctgtgtgggggctctgaccccatatttcccttctttactgcattggtagaggttctccataaaggctccacccctgcagcaaacttctggctggacatccaggcatttgcatacatcctctgaaatctaggtggaggtttccaaacctcagttctttagttctatgtacccacaggctcaataccacatggaagctgccgaggcttggggcttgcaccctctgaaggcacagcctgagctgtgtaccttggctcctcttagccatgactggagtggctgggcaccaagtcctaaggctgcacacatcaggggggccctggacccagcccaggaaaccgtttttccctcctaggcctgtgatgggaggggctgctgtgaaggtttgtgatatgccctggagacattttccccattgtcttggaattgggctccttgttacttttgcaagtttctgcagccggcttgaatttctcttcagaaaatgggtttttctttttacattgtcagactgcaaatttccacactttttttttttttgagatggagtctctctctgttgcccaggctagagtgcaatggcatgatctcggctcattgcaacctctgcctcctgggttcaagcaattctcctgcctcagcatcccgagtagctgggattacaggcacccgccatcatgcctggctaatgtttgtatttttgtagagacaggatttcaccatgctggctagactggtctcgaattcctgacctcaagtgatctgcccaccttggcctcccaaagtgctgggattacaggcgtgagccactgcgcccggccaatttccacccttttatgctctgcttcctcttgaatgctttgctgcttagtaatttcttcccctagatgccctaaatcttctctctcaagttcaaagttccacagatctctagggcagggtcaaaatgctgccagtctctttgctaaagcatagcaaggatcaggagaacagcatgggggaaccgtccccatgatctaatcacctcccatgatgtcccttccctaatatgtggggattccaattcagattacaattcaagatgggatttaggtggggacacagagccagaccatatcagtaatctcttgggctaaccaataaccaatgtattcttgtattttttctttgaaattttataaatatttataaatttaaataacatttaaatcaaaatggattatgttgtaatcattactctgccagttttttttttttaatttttaaatttattttttgtagagacaggatctccctatgttacccaggctggttttgaacccctggactgaatcgatcctccggctttggcctcccaaagtgctgggatcaaagtttgttaatttgatagctaaaatatattttcatctgcatttcaattacaattagaagctatgtatcctgcaacatattttccagcaatttgtgtattttcagtgtgtctttctgagtcctttttgggtatgcctggactagtttgtctttttcctgttagtttgtaagggctcttgttattgtgggacctttcctctttgtccatcacctgtattgtataaatattttgttacaggctattgttttcctattggcatattaacatttgagtcttgttcttactagtatgtagttttgcaaggttgcatttgtagcttgcatactgtctcctatgtttttatttactgtaataagtattttcccatgtacccacgtaacctttttaattaaacctataaatgtccaatcgatagttccctgtgttggtgggctataatcacataattattatctgtggtttgacatttgggttgctgtgttttctttctccttttttttttttattattatttttgagacggagtcttgttctgtcgcccaggctgaagtgcagtggtgcgaccttggctcactgcaagctccgcctcccaggttcacgccattctcctgcctcagcctcccaagtagctgggactacaggcacctgccaccacgcctggctaatttttttgtgtttttagtagagacggagtttcaccgtgttagccaggatggtcttgatctcctgaccttgtgatctgcccacttcggcctcccaaagtgctgggattacaggcatgagccactgtgcccagcccctttctccctttttaacttttttgagacagcatcttataccatcacccaggctggagtgcattgcgcaatcttggctccctgtgacctctgcctcctgggttcaggtgattctcctgcctcagccgctggagtagctgggattacacatgtgtaccatgatgcctgattaatttttgtattttcagtagagatggggtttcaccatgttggccaggctggtctcgaactcctgacctcaggtgatctgcctcccaacgtgctgggattacaggcgagagccaccatacccagtcatttttatttttcttttaaagaaaacactgtcctgaataccacatgggtagagtgcgtattggcttatttccttagatgatgttctcaggagtggaatgaataacatctgaaaaggcttcactctagccattgtcttattttctaaaagtgagctggcccagctcaccgttctagcagggtctaaggttacttactgctgtggttattattcagagtggacgatggtgcatgttaatgtcaggcacagcagggcgcggtggctcacgactgtaatcctagcactttgggaggccgaggtgggcggatcacgaggtcaggagttggagaccagcatgaccaacatggtgaaaccccatctctactaaaaatacaaaaattagctggcgtggtggcaggcacctgtaatctcagttactcgggaggctgaggcgggagaattgcttgaacccaggaggcggaggttgcagtgaactgagattgtgccactgcactccagcctgggtgacagagagactttatcttaaaaaaaaaaaaaaaagtcaggcttttctagggttcctccatcagccttgtaaggctggagacccgtggccaggaagaaaattggagctgtctggcactgggaagggtaacccagtagttataattaggttggcttatctgcgagccctttgataaggcttcactaatttactaacccaggatcgcatgttagatcaggatctctctgagtgctgcaattgtagtttgcttttctctctctcttttttttttttttttagagacagagactcactctgttgcccaggctggagtgcagtggtatgatcatggctcactgcagccttgaactcctggcctcaagcgatcttcctgccttaccctcccgagtgtcttggattatagatgcttgtcaacatgcccagctaatttttaattttttttagagatgaggtcttgccctgtcacccaggctggagtgcagtggcatgaacatagctcactgcagccttaaacttctggcctcaagcagttctcctgcctcagccttccaaagtgctgggattacaggtgggcaccactgtgcctggcctgcagtggtttaatagggctctttcatctttaactttggtcccctgccccctgagatccgtggagtgagccgtttgacgcttggtacttgggacaaagctggcctatgtccagttctctgcatacttggtaggggagtgtttggagaaaaggctcacctctgagtcacaccctctatattctccaaagggccatggggatggggtggaggaggctggggtgaagagatgttgtagctccagagaaagccagggaggtgtatgctgggtgaagaggccaagttcaggagcctaggtttgaaaatcagtatagacgattcaggttaattcaccctgttgttatagagcatctgtctgtagggtggccaggtctgggtgagtctcttggacaagatgggtatcaggtttcagctctgaaattggactgatatgtggggagattcattctgcagttttatttgtagtttaggtttaagaaaacttggactgggcactgttgctgtcgtctgatcccagcacttagtgatgctgaagtgggaggatcacttgagcccaggagtttgagaccagcctgggcaacagaaagaccccatctctacaaaataataataataataattattattattattattagctgggcatgatgggacatgcctgtagtcccagctactcaggaggctgaggcgggaggtttgcttggtcctgggaggttgagctgcagtgagctatgattgcaccactgcactccagcctggacaacagcatggcactgtctccaaaaaaaaaaaaaacaacaaaaaaaaaacttgtttaactacctaaatcatagcatttgtgtgaagccagactatcacaactctgagaactgctgacatatacatattttggaagttccaggttttctgttactataaacatggtagagattgaattacttaaagggacgtcttttctcctactctttgtcttgtctgatgttataaggggtacagtatagaatgaaaacagtgcagaaatgagtgaaacatgaaaatcccttctagagataattttcttttattatttttttgagacggagtcttgctccattgcccagtctggagtacagtgatctcggctcacggcaacctccacctcccaagttcaagtgattctcctgcctcagcctcccgagtagctggggttataggtgtgtaccatgcaccaccatgcccggctaatttttgtatttttagtagagacagggtttgctgtgttagccaggctggtctcgaattcctgacctcaggtgatccgcctacctcggcctcccaaagtcctgggattaccggggtgagccaccatggccagcctcttctagagacaatcttattggcaggttgatgtttttaattttcagcctctcttctccacagatcctaaagatatagtaatttttttttttgagacagagtcttgctctattacccaggctggagtgcaggtggcgtgatctctgctcactgcagccttcacctgccgagtagctaggactgcaggcatgcaccactatgtctagctaatttttgtatttttagtagagatggggttttaccattttggccaggctggtctcaaactcatgacctcaagtgatccacctgccgcagcctcccaaagtgctgggattacaggtctaagccaccgtgcccagccataaatacatggtattttttaagaacaagaacgggattctacaaaaacatatatatgtgtattttgagacaggatctcctctgttgctcagggtggagtgcaggggcacgatcatggcccactgcagccatgacctctcaggctcaagcaatcctcccaccttagcctctggagtagctgggaccacaggtgcccaccaccatgcccagctaatattttttcttttttttttttgtattgaaaacagtcagccaggtgtggtggctcacacctgtaatctcagtacgttgagaggccgaggtgggcagatcacttgaggtcagtagttcaaggccaggctgtccaacatggtgaaactccatctctactaaaaatacaaaaattaactgtggtggcgcttgcctataatcccagctactgggaagggggaggcataaggatcacttgaacctgggaggaggaggttgtagagagccaagatgatggcactgcactccagcctgggcaacagagcaagactctgtctcagaaaaacaaaacaaaacatatagtctttatttttttgtttgcgtgggctggtgcatcttgattatgatgcatttttgttaattgatatttaattgcagatgaaatgtaacatggatctgagtaattgctgataattgtttcctctttaggcagctggtcagtcttttttttttttttttttctttttaagagagtttctgtcttgttgcccagactggagtgcagtagcgtgatctcggctcactgcaacctcctttgccagggttcgagtgattctcctgcctcagccccccgagtagctgggattacaggcatgtgccaccacgcccggctactttttgtatttttagtagagacgggttttgccatgttggccaggctggtctcaaactcctgacctcaggtgatcccccctgcctctgcctcccaaagtgctgagattacaggcttgagccactgctcccagcccatagtcttttttttttttaaacctctgtgtacaggtaggtcctggggaaattcgaggcaagacttgggtgagtgggtatcttagaccctctcaggagctctttgcaggaggtagaatctccgagggtcagtgcccatgaatgggtcccatggcctgactggtcccattcaggtgacagtctctgagggtcctgcatagcccttacctgggctccatgctgggaatcgagcggtatacagagcatggttccctgccttccttgagccccagtcttgttggggaaatggccaaataaatgaataatcatcaggaagtgctatgaaggggagctgcgtggtgcccggtgagtgcaatagcggggtttcatctggttggagagaaaaaaggagactccttaagtggggaacccgtttgatgatacaggtttggctatgtgtgtcaaagaccccaaatatagtgggttaagatacaagctcatttctctctcatgtaaaaatcccagctggtgtggcagctctgtccccaaaataatcagggtcccaggcccctcccatcttgttgctctgctgtcctcatctgcatggatcaagatgatgcatctccatgtccacatggcagccagtaggaaagcagagtaagggcacaacctggaggttgcctacgtctctcctcgtcacatcccattggcttgtacctagtcatgtggtgcctctagctgcaaaggaggctgggaaatgtagtttcctttctaagcaggatgtacccagctgaagatgttactcagggatgagggagagttgatactggagcgcagctagcagtttctgctgtataggcaaaagcagaaggtaagaatgttctgggcagtgggaaatgcatgtgcagaagcactggcttaatgaggaaggccactgtggctggagtcaaagagtagggaagagaaaaagaaccagaaggaggctgagaattgggcctgtaggacttggatcctgtgggaagccttggcagctttctttcccccctccttgcttaggcattagctctaagacagggatatttacaacacaattatttctttaaaattatatatatattttaatttgtacagatgaggtctccctgtgttgtccaggttggtttcaaacccctgagctcaagccatcttcttgcctcggcctccgaaagtgttgggattacaggtgtgagccattatacctggccttcaactcagtccctaaagacaactccttctcaagtgttggaaagaaccaatgactaatcacttctagtctgccttatccccatcttgcttgtgtgactttggtaagagtttgtttgtttatttaaaggagcagagagtttaataggcaagaaggggcaagaaagaagggagaataagatcccctgtatagagacggaggagggctccaaagctgagagagggaaccccagctgccacagatagcagctaggtatatgtacagaggctggaagaggcagtgtctgatttgcataggcctcaggggattggtttgactaggcatgtctttcacgtagcgcatgaaaaagctggccctcccacctagccttttaatatgcaaatgcagggtaccatgatctgcacacttggggaggtgtggtggcggccatgttgctaggaacatgtggggaaagggcaagaaggctgtgggaatcgccatgtttgggtggacccagtttctaatggcttgcatttgcatatcaaaggttgctggcctggctctaagagccggggctttacaagaaacttttccggagttgctttaaaaaccaaacatttcccaaggaccccttttcctctctatttgcctaaaataattgcttaactcctacattaccccctgtggagatgccacattaactgctgttagggggttttgggcgacgacttcttctggctacttcctggtgaaaaggggcgttgaatggggaacagcagctagggctcctcctggggtggatctaagggtcctcggaagaatggcgtgtccatgtgtgcttcaggttacagcaccattttgagtttgattgcttcagtctgatgaaataatttcctttcctggccaacacaccaaaatgatacggctccgatgagtgggggaacaccagggttcttggtcctcatgccggtttagataaaatgacacagacacacgtggagtggttttaaggagtggagagtttaataggcaagaaggaagggagaaggaagaaggtcccctgtacagagacagagggtggggggctccaaagctgagagacggaacctccaggagttgattttataaataaaataacatgcgttgaggtcactctgtgttgtgtggtatgcccagccctctctgcacataacttgtttcaggcccacagtcatgctgggtggttgctgtaatgactttttattttaaatggggaatctgtgacacagttaaacatgcgcaggatcatgtcactagcaaggagtggacacggtattcaaacccagcaggttgactcaaagcctgccctttccccagctgttttgcccctcagtcatttgagtctagtcttcaggattttgacatctatctcttaccttgtatctgttaggattgcatctggcttcaagaaacagccctacttcagcagcctaagcagaaaggtattcatttgtttattttttacatgtcaggaattccagtacctcttggagttgctggcattggattagtgatgcagggttgttaggactgacatctctgctgttttcttgtcttttcctcaaggcccctaaatggctgctacagccctaggcaatatatctgggttcaaggtaggaagagggagggattgcaccagcctcatgggttcctttctattcaggaaagtccaagccttcttcaaaggctcttctgtccacattgcagacttctggtcatgtctccttggctgaaactggattacatgaccacctctagctgcaagggaggcaggaaaaatgagcatttggttttatgcttctctaggaggaaacagcaagggagaaacttttgagtaagccagccaatattgtccaacatgtacttattttttaactttttttttttttttttttttttttgaggcaaggtctggctggctctgttgccgaggctagagtgtggtggcacaatctcagctcgctgcaacctctacctcctaggctgaagctatcctcccaccttagcctccagagtagctgggactaccacatgcaccaccatacctggctaatttttatatttgtagagatggggtctcaccatgttgcccaggctgctcttgaacttgtgagttcaagtcgtctgcccacctcagcctcccaaagtgctgggatgacaggcatgagccatcacactcagctaatgtttttctttcaatcaattcactttttaagccttaacaaagttatcgcaaaaggaagtttcatatcactttagaatgtctttgaagtcacaggttggttatatttatgtgcttactttaatagctattaaagtaaatatagcactactaagaaaaaaagatattctttaaatcgcctattatcagtggttcttaactctggatgattttgtctccaggggacatttggcaatgtctggaaacatttttggctgtcacgatggggcagggagcgcacgcctagagtctagtgggtagaggccagggggtgtgctaaatatcctacaatacaggatgggctccataatgaaaaatcctctggtcccaaatgtcagtagtactgcagttgagaaaccctggcatggacgcaatccacctgctgccaggagttatatacaagccatgttagggtaatgctgcaatatgtccatcgtgattgtgttttctcctgggtgactatcagcaatggtgtagcctgcttgttggttttcaaggtccattctcaagatactatcagatctccagcaatcgtgtgatgcagtttaaaatgttcatgtgagctgggcgtggtgactcatgcctataatcccagcactttgggaggccaaggctggagaatggcttgagcccaggagtttgaaaccagcctgggcaacatagcgagacccagtctctacacaaaattaaaaaaaaaaaaaaattagcccggtatgatggtgcatggccatggtcacagctactcaggaggcagaggtgggatgatcacctgggcctgggaggttgaggctgcggtgagccacgattgcaccaccgtattccagcttgggtgacagagtgagaccctgtctcaaaaaaaagaatgtgcatatgaattcaagatatgtcccttatagagactggtgaggacacagcttattgaccctgaagctgaagtggttgaaatgatagccctcttgccaggcaaatcctatgtgagtgcttctaaaagaacactgtaccttgcagagagtattcctgggacctggcaggaatcagggcctcttggtgaccacatgctttggaaagggctgtgctttggcaagtgggagattttattatttattttctcctgtctgcctcggtttggcaaaaacaaacctggcctgggcatgggccttgtggagacaagaaggcagcttgagattatcagagatcaggctgctggtgggtttgcctgagctggcctggtcaggtagcttgacaatgatgctcagacccccattaaagttaattgagcggttacagagtgggagtggggagtggggggtgtggtgactgcctgtctccttgagttggcgtggctaagaagtaagggaattttttaacttttccttcttaattctggaaacttagaaaaaagcctctcaccatcccttaatcattcagttagagagaccaggctgttgatatggacatgctgcgtttcatggaatcctagaggccagtatttatgacatacttcccagtttcagagatgttaggatataaaaatgtagccagcagtgtttacaggatgggctaatcgagagacacagacaaatatcaaagatagcaaaataggaagaaacagagtcttagaatcaatgcagtataataatagcttctagtttctttctgtttttctttttatgatacagagtctcactctgtcgcccaggctggactgcggtggcatgatctcggctcactgtagcctccgtctcctgggttcaagtgatcctcccatctcagcctccaagtcactgggattacaagttgtttgccaccatgcccagctaatttttgtatttttaatagagacagggtttcaccatgttggccaggttggtcttgaatgcctgacctcaagtgatcccccccagccttggcttcccaaagtactgggatgacaggtgtgagccaccatgcccagcctccccctcactcttaagcacagctcttcggcagtcagagatgttgcctgctgtatttctcgttctgcttttacacatggtttaaaaatcctcgcccaagaatgtaagccccatggctagtgctacctgctacctttaggggtggcctctcctggggtgcaggaggttgcacagttcgttttgtgacagcagggtcattttttaatcggatcatctgccccagtttgcttggctcttaggtgcttgggagttctcctggttttttgctgttgtgaaatggcccagcttgtacacgttgttccttttcttgctggagttatttcctttagactcctgtccctaaagtaggattgttgggtgaaaatggggtatgcgtggttaggcttttctctgcctgctttctggattgctcttcagatagatttaatcaccttttatttatgttttgtggtggttttttttgttttttttgtttttttttgttttgagactgagttttggtcttgttgcgcaggctggagtgcaatggtggggtctcggctcacagcaacctctgcctcctgggttcaaacgattctccttcctcagcttcctgagtagctgggattacaggcatgcgccaccatctctggctaattttgaatttttattacagacggggtttctccatgttggtaaagctggtctggaactcccaacctcaggtgatctgcccgcctcagcctcccaaggtgctgggattacaggcgtgagccgccacacctggccaccttttatttgttgaatgagtgtttaataagcatgtcctatatgcatcaggagaattaaatggacatggtcttgctttggggggaaatgacaggtaggagagaaagagacacttagaactcaacagaggccagacgcggtggcttacgcctgttatcccagcactttgggaggctgaggtgggcggatcacctgagatcaggagttcgagaccagcctggccaaaatggtgaaatcccgtctctactaaaatataaaatcaatcaggcgtggtgatggcacatgcctgtgatcccagctactcgggaggctgaggcaggagaattgcttgaacctgggaggcagacattgcagtgagccgagattgcactactgcactccagcctgggcagcaagagcaaaactctgtctcaaaaaagaaaaaactcaacagagaaaaggcggatcgttaaggcttctttggcacttcctaagtgccagggactgttgttaatgcctttgaagtgctaataatgacttaatggtgacaagttccctgtgaagcagggactgtgattgtttctaccttatgggtggggaaaggaggcagagagaggtgaagtcacccagctagtaaatgacaggactagactgaaacccaggcagtctgtctccagggcctggccggtaccccatgctccatcttgccccataaacaccctggggtgggccagagaggagtcttttccaacaggctgtgccagatgactttggctaatcttggaggctggaggattagtcagtctactaagggggcttcagcattttggcacgtggctttatgagctgtttactccaacagtgatgatgacaatagccatagtagtgataatactatggtagaagtaactgcagcaaactcaacccctaacgagtattctatcttcccaacattgtgtgcaatagccatgagagatgggtgttattcttttaatttgacacacgggaactgaaagccagagagattgggtggcttcccccaggccacacagcctggaagtagtaggacagggactcgagcccagatctgctgccccagagcctgtgcccttgaccaccaagtcatggtcactcctttcaaccctgcctgcccctgggccatctgtgttgtgatgccggctggccaggatggggagtgaggatttcagtttgtcatagggcagggagatgggtgaggcaggacactccttgagatggaaggctctggggtcgggggagagggagtggtggagactggggtgtctccgaaggagtgtttgaagatgacggtggtttttccagtttcctgttcttagctatattcaagaaaagggtaagccagaaaatttccctctgagtttcacaacttctgggagcttttgcaaagtctgggtgatgcagcattttcctggtttgaatcctaagtgaagtttcattttccttcacttaactcattctggctctggcctgtcttcccagctgtattggccatctggtcctcttctggctctttgtcccatttattattatttatttttatttttaacagagatggggtctcactgtgttgccgtctgttctggaactcctggacccaagtgatcctcctgcctcggtctcccaaaatactgggattataggcatgagcctctgtggccagcttataccccctaagcttgtgactatcttctatgtgtgtccctcttggagtgaggttccctcctgtctccatgttggcaaatcttagcaccttggcccttcgagatggaggtctgtgttgcctaggctggtcctgaactcctggtctcaagtgatcctcccatcttggccttccagagtgctgggattacaggtgtgagccactgtgtccagccaacccttcttagattttacttacttcaagaagcctgctttgacctctcaagtggaaataacaacttccaggaatagagtgatcactgggcatccatctgttgtcacatgaatgattttatccatattaaggaggcattacatgcagcagtgagctaacctgcctgtgttgaagttttcttctttttacaggctgtacaaccttgggcaagttgctttacttctctgtgccttagtctcttcctcagcaaaatggaaaaaatactacccatttcaaatggggtgaaaatgaaataatatataagtctcgtcttcacaatgtctctgatgaaaagcaggtattggttgcacatggtgctcatgcctgtaatcccagcactttgggaggccgagcagggaggattgcttgaggccaggagcttgagaccagcctggggaacatggccagaccacatctcttaaaaaaaatttagctaggtttggtggcatgcacttgtggttctaactagtttggagcaggtgaggagggaggatctcctgagctcaggaggttgaggctgcagtgagctgtgattgcacacgactgctttccagcctgggcaacagagtgaaaccccatctcaaacaaacaaacaaacaaacaaacaaataaacaaaaaacaggtattgtccttgctgtatgaatgaggaaagtgagttttcctttttgctttgtgaaactcttttctggatatttcttgccttttatgtgtatctctttggtggtactctgtgcttttaaaatcttttgtaatggccatttatggacaaatcgtatcttatattcaagattctaagctttctgagggcaggatataaatgtggttgtttctggttcaagtcctgatacaagcaaagctcagtaatttttttaaatgaatgggtgggccggtggttgggtcttcagagtcactaaatactggtggcaggagtgggaccacatagaaaaaaatattaaggcagtggatctcaatggggagtgatctgcctctcagaggacgttcattgatgtctagagacatttttgttgtcacagtttgggatgggggtgcagttggtgtctgttgggttaggatcaggaatgctataaacatcctgtgatacacgggacagacgtatccagcctaaaacgtcagtagtgttgagggtgagaaaccctgggcttattaaggcaacaagcaacatattaatagcaacaggagaaaacatgcatttaaattttttttggccaggcgtggtggctcacacccgtagtcccagcacttcggggggcccaggtgggcggatcatgaggtcaagacatcgagaccatcctggtgaacatggtgaaaccccatctctactaaaaatacaaaaattagttgggtgtggtggtgtgtgcctgtagtcccagctacttgggaggctgaggcaggaaaatcactttaacctgggaggcggaggttgcagtgagctgagattgcactactgcactccagcctggagacagagcaagactctgtctcaaacaaacaaacaaacaaacaaaaaaaaaacaaaattttttttccacaaatgtgaagtagtctagatgagatacgctcttcctgagatgataaagtgaggtctaagtgtatttattaattcttttgaggagggtgttaggtgctaaaggcagcacgtgtaaggtgaaaattgcgtatagccaaaatgaccctggggcttattctctctctctctctcttttttaataaacagcttttttgttgagatataattcacataccatatgatgcacctataaagtgtgcaactcagtttagtacattcagaattgtgcatgtctcctgtctccaggtaggcaaatcttagcacctcggcccttcttagattttattttttagagatgggggtctcactatgttgcccaggctggtcttgaacttcttggccttcctcccatcttggccttccagagtgactatattcaatattcaaagtgactgtagtcaacattagatatttttatcaccctgcttacttgtttttatttaagacctggtgtggtgtgtgcctggccttgtgatcacaaatgctagttacactgaattgacattttgctgagactcgttctgaggtccattcatagatgccctaggtacttcctgattacttgccacaccccaggaattctgcacagtgagtggggagtgacattttgagggacagcatcagtacattcactgcgctaaagaaacagtctggggagagtgagacatcgaaaaaataacatataaaataaacatctgatggagacataggaagatgccaaccttcaacaatgtttgacttggagcaggggttggcatgctttttctgtgaagggttaggtagtacatattttaggtctctcaggcccaggggcaaatagtctttcttataatatgtatttaaaaattggccaggcatggtggcttctgcctgtaatctcagcactttgagaggccaaggtgggaagattgcttgagcccaggagttcgagaccagcctcagcaacaaagtgagactctgtttgtattagtctgttctcacgctgctataaagaactgcccaacactaggtagtttataagggaaagaggtttaattgactcacaattccacagggctggggagacctcaggaaacttatactcacagcagaaagggaagcaaacatgtcctccttcacatggtggcaggaaggagaagtgctgagcaaaaggggaaaagccgtttatcaaaccatcagatcttgtgagaactcactataatgagaacagcatggaggtaactgcccccatgattgaattgtctctcactgggttcctcccacaacacatggggattatgagaactacaattcaagataagatttgggtggggatacagctgaaccatataattccatggccaaatgatatcgttctgcccctcccaaatctcatgtcctcacatttcaaaacacaatcatgcctttccaagtgtcacccagagtcttagctcattccagcattaacccaaaagtccaattccaaagtctcatctgagacaaggcaagtcccttctgcctattagcctgtaaaactgaaagcaagttagttacttcctagatacaataggagtacaagcattgggtaaatacacccattccaaatgggaaaatttggccaaaatgaaggggctgcaggccccatgcaagtctgaaatccagtggggcagtcatttcttaaagctctgaaatgatctcctttgactccatgtctcacatccaggtcatgcttatgcgagaggtgggctctagctatggccttgggcagctctgcccctgtggctttgcagggtacagcccccatcaaggggctttcacgggtttgtgttgtgagtctgcggcttttccaggtgcacggtgcaagctgtccatggatctaccattctgcagtctggaggatggtggccctcttctcacagctccactaggcagtgtcccaatggggactgtatggggcctctggccccacatttgccttctgcactgccctagcagaggttctccatgagggctccactgctgcagcaaacttctgcctggacacccaggcatttccatgcatcctctgaaatctaggtggaggttcccaaaccttgattcttgacttttgtccacaggctcaataccacatggaatctcctaaggcttttgaggcttgcaccctctgatggcacagcccgagcagcattttggccccttttagccacagttgaagcaactggaacaaagtgtaccaactccctaggcagcacacagcaggggggccctgggcccggcctatggaatcattttttcctcctagacctctaggcctgtgatgggaggggctactgcaaaggtctctgacatgccctggagacattttccccattgtcttggtgattaacatttggttccgttttacttatgcaaatttctgcagcaggcttgaatttttccccagaaaatgggtttttcttttccgtcacatcatcacccttccaatgtttcaaacttttatgctctgcttcctcttaaacactttgttgcttagaaatttcttctgacaatcatctaaatcatctctctcaagttctaagttccacagctctttagggcaaaggcaaaatgctgccactctttttgcttaagcatagcaagagtcaccttggctccatttcccaagaagttcctcatctccatctgagaccacctcagcctggacttcattgtccatatcactatcagcgttttggtccaagtcattcaataagtccctaggaagttccaaactttcttacatcttgctatactcttctgagccctccaaactgttccagcctctgcctgatactcagttccaaagttgcttccacatttttgggtatctttacagtagcaccccactcccagtaccaatttactgtattagtttgttctcacgctgctataaagaactgcccaagactgggtagtttataaagggaagagatttagttggcccacagttctgcagggctggggaggcctcaggaagcttgtaatcatggtagaaggggaagcaaacacgtccttcttcacatggcggcaggaaggagaagtgctgagcaaaagtgcttcttttgctgagaagtgttgagcaaaatcagatcttgtgagaattcactgtcacaagaacagcatggaggtaaccacccccatgattcagttacctcccactgggtttcttccatgacatgtgaggattatgggaactgcagttcaaaatgagatttgggtggggacacagccaagccatatcactgtctctaccaaaaaaaaaaaaaaagccaggtgtggtggctcatgcctgtatcccagctactcatgaggctgagatgggaggattgcttaagtccaggaggttgagactgcagtcagctatgaccacaccactgcactccagtctgggcaacagagtgagacgctgtcaaaaaaaaaaaaaaaaaaaaaggaaatccattcttagcctgtgtgctgtacaaaagcaggcagcaggctgaatttggcccacaggctgtggttcgccaacttatgacctatacaaatggcaattcatatggttcatcctagcgataactgtacatggtgtattagatactatatagcatgttcatatcaaatgtcatataatgtataaggtaacatatacagtataaaatagtgcctgagaaatatttgatgaaaaaatctgataagtacttagcaggcacagtacaaagtaccatgaagttgttaaatgggggatcagggtgtttgagaaaggggtggggagataggtgggcctccctcaagaaggaatgtttcaactgtgagctgaaggatgcccctgcattgcatgtcagggcagtgatggggagaaagactccaggtagagggaacccactctgcaaaggccctgagtcatgaaggggtccctggaacagtgagttggggctgaacccacaagctgcagttgtggggattgtgatccatcctgagagctctgagaacctggaatagttttcagcgcagtgtgaagggactggggctgtgttttgaagatatcccctgtctgcggttgggaggggagtcaggaaacctatttggaggctggggttttcacccaggtcatgcagataagatttattaggtgtggaatgaactgagcaaatcacatgtcttctaatggtacaccacactttttttttttttttttggttttgagacagtcttgctctgtctcccaggctggagagcaatggcatgatcacggctcactgtagccttgacttcccaggttcaagcaatcctcctacctcagcttccggagtagctgggactacaggtgcccactaccatgcctggctaattttggtatttttattggagacggggtttcatcatgttggccaggctcctctctaacttctgacctcaagtgattcgcctgcctcagcctcccaaagtactgggattacaggtacaagccaccgcgcctggcctttagtgatattttaaagactaaattcccttagagatgcctgggtctgcatttattgctactgttctgtttctcactgtgtgtcttgaggtcatcaaaagtaacctgggccttttcccttgttttctgcctcctctaggcttatgagccattaagcaaagccggattggtgtgtgggtcaggctcttcatgttttctttagcttaataagcagtttctaagggaactcattgtgtcattgtttagaatagcaaaagatgagcagcctcccaagtggcaatcagtaggggctgggtgaatacagtgggttccaccccttccgtggtagggtgggatgcttgcagaaggacataagacgaggaagccctttgtgcacagatgtgcggcagcctccaaggtccagtttttaagtgaaaacgtggagatccacttggtatatttggtatgttacctctgtgtaaaaaagcagacaagtaagaattacgtagttgtatttgctgtatttgtaagaaattccagagggataaatgagaaactaaaagaggcaattgcatttgggcagagtaactttttattgtttaccttgatatatactttttttttttttgagatagagtctcgccctgtcaacaggctggagtgcagtggcgtgatcgtggctcactgcatcctccgcttcccagtttcaagcgattctcctgcctcagccttctgagtagctgagattacaggtgtgtgcgccaccaagctcagctaatttttggtatctttagtagagattgggtttcaccacgttggctgggctggtctcgaacccctgacctcgtgatctgcccaccttggcctcccaaagtgctgagattacaggcttgagccaccgcgcccggcctatatatgtattatataaacatatgcacacgcatgcatacgtacacacatatatattttttaaaaattgagtcatggccaggtgcagtgtgggtcacacctgtaatcccagcactttggcaggtgaaggtgggaggattgcctgagctcaggagtttgagaccagcctgggcaacatggagaaaccccttctctacaaaaatcacaaaaattggctgggcgtggtggcatacacctgtggtcccagctgcctggaaggctgaggtgggaggattgcttgagcctggtaggtagaggccgcagtgagccatgatcacgccactgcactccagcctgggtgagagagtgagactctgtcttaaagcaaaaacagagtcatatatttcctattaaggtgaaatttaaaaaataaattcctatattccatcatccccagcttctgccattctaaagcattttcctaagcagctccactgtggatgtagcgggtatttcagaaaggcattagaaatgccctgggagggcagaacccggggcttcactggaggtgctgttgggctcagtctgatgtcaaggcagggacatggcaagggtattgagatgtgaacaagcattactcagcaaggtgacatgtgttcatgccttgatacacttgtttccccaccagctctatttttgttgcctgctctattggtttctttttcttttttttttcttttgagactgagttttgcttttgttgcccaggctggagtgcaatggcaccatctcggctcactgcatcttccgcctcctgggttcaagtgattctcctgccccagcctcctgagtagctgggactacaggtgtgcaccaccatgcccagctaatttttatatttttagtagagacggggtttcttcatgttggtcgggctggtctcgaactcctgacctcaggtgatcctcctgctttgggctcccaaagtgctgggattacaggtgtgagccactgtgcccagtctctattggtttcttattgctggtattgccatcaacttggtgactgagaacaacacacatcactctagttctcgggagtcagaggtccaaaatgtacggctggtgttctttccggaagcttgcagggagaatccatggcctggccctgtccagcatcaagaggccacctgtcttcctcaattcgtggtttcatgtccctccacccctgcttgtgttgtcaaatctcctttactttttttttatttttgagacggaatctcagctcactgtagtctctgcctcccaggttcaagtgattctcctgcctcagcttcctgagtagctgggattacaggtgcatgtcaccatgcctggctaatttttgtatttttagtagagacggggtttcaccatgttggacaggctggtcttgaactcctgaccccgggtgatctacctgcctcagcctcccaaagtggtgggattataggcatgagccaccacgccctgcctcaaatctccttttctgactcagatattcccaccgtcctcttgtcccttataattccctgtgattacattgggcccacctggatcatctaggacaggggtccccaactcctgggccatgaaccagtagcgagcagtctgtggcctgttaggaactgagtcatgcaacaggagctgagtggcgggcaagccagcattaccacctgaattccacctcctgtcagatcagtggctgcattggattctcacaggagcgtgaaccctaacgtgaaccgtgcatgcgagggacctaggctgtgtgctccttatgagaatctaatgcctgatgatctgagggggaacagtttcatcctgaaagccaccccccgccatccctggcaaaactgtcttccatgaaatccatccctggtgccaaaaagcgtggggacctctgatctgggacattctccccattccaaagtccttaatgatacctgcagagtcccttttgccatgaaaggtaagagactcaggttctggggacggggatgtaggcatctttacgggctattctgtgtactgcacctgttcagcttagttccaggcacatagtaggggctcagtacatctttgttgaatgacacaatcaatcatttggttaggctagagaatgtggaaggaggccgggtgcagtggctcacgcctgtaatcctaaggctgaggcaggtggatcacttgagctcaggagtttgagaccagcctggacaatgtggcgaaaccccatctctcctaaaaatagaaaaattacctgggtgtgatagtgtgtgtctgtagtcccagctactcaggaggctgaggcgggaggatcacttgagcccagaaggtggaggtttcagtgagctgagatcatggcactgcagtccagtctgggcaacaaaacgagaccctgtgtcagaaaaagagagaatgtggagggatattatagcaagaagtggatctggaagttttactagtagtggtatttattgagcacctactgtgtgctctggctcatgtttaacaaagtgcttatttgcataatgttagtattcccattttacagatgcggaaactgaggtttagttgctggcctagtattacagggtgaggagctgaagccccatctgcctgacgaggggtgtgttggggatgtggactagaagcttggtcagggagggattctgttcaaacagggctgcttagctttggcactgttgacatttggggccagatatttcccgtcgtgggggctgtcctatgtattgtggccattaagcagtatccctggcctctgtccacagagtgccaatagcactaccctcttcctaagttgtgaaaacccaggatgtttccaaatgttgtcacatgtcccctgagtgacaaacttgcccccacttgagaaccatggtgttgaaacatagatcacggcacatcaactccatgctcctcaggtcaccctgcgtgaaagtcagaatccctgcggtggcctgtgcgtcccgcactgactgtctcctccctgccttcttccttcctcgctgtcttcactgcttgttattcttcagacctgttggcctctctgcggtttctcagaaatgccaggcctggtctgacttcaggacctttgcactggctgttttctctgcttggtgtgcccttcctccagatggccatttggtttactcctctgtttccttccatcctgtatttgtttatttatttttaattgagatggagtctcgctctgtcacccaggctggagtgcagtggtgtgatcgcagatcactgcaacctccaccacccaggttcaagggattctcgtgcctcagcctcctgagtagctgggattacaggcatgcactaccacgctatgttggccaggctggtcttgaactcctggcctcaagtgacccacttgtcttggcctcccaaagtgctgggattataggtgtgagccactgtgcctggctcaatcctgtatttaaatacccgtcctcagcaaggcttgccctcttctctgagtgcttttcatcacacatgtcttcatatcctctcctttctaaaccatctgtctcttctctttaggctgtcagctccaggagggccggcccttggtccctattgttcactgctgggccctcagccctaggaaccgtgctctgtaaatggatgaatgctgtctgtcctgttactgcagtgtccccagacatatccctatgcccagcacatgcctgacccctcacaagaccctggaacatgactaagggatttatttggtgaaacatgagagtctgataagaggagaggaagtggctggggagcaaccttgcaaagatagccagggttggatggagaaaacgagggtgagtgtcagcttcataggacgggccttccacgagaggcctcatggtgcttgggagagttggggtgaaagcaggttggaacaagatgcttgctgctgacatttgggcactgatgggcagcctgacctctgctttctttttagtgcttaacaacactgaagccctgttaagacaggattcttaggactgggcacagtggctcatccagcactttgggagccctgggtgggaggatcatttgagccccaggagtttgaggccagacagggcaacatagcaaggccccatctctggaaagaaatacaaaaattaaccaggcttggtggtgtgcacctctagtcccagctacttgagaggctgaggtgggaggatcacttgagcctgggagttcaaagctgtaatgagctataatcatgacattacactccagccgaggagacagagcaagactctgtctcaaaaaaaaaaaaaaaaaaaaaaaattagttttgcatgtaactgtgttcagttctgtgtcttggacgtgaggatttgtggtacccgcctggatagagcaaggatggccgtgcccctgccttcctgggtgatggggataagtctggaaattgcccctgtgatgttactgggctttattcttagctctgctgagttagggggcagggtggggtgcagcccagccaacagcatgccagggcgcgtcactgcccacgcgatgctggcttcagccgccttcctctcacctcatggccctgccagccgtgcttgcctcctgctgtgtcggggctgggagactttagcctttctccagatgttttcaggagtgcggtggggaaatgaaggccacatgctgtctctctaaacaggattaatgttcagaagcccagcgggtgccctgacctaaccacgggcctcttgcactccttttctcagcttcccttggcttctgagctacccctctgcagcgttgtttctgagtgtggcatttaggagcaccctgtcgtcttgcctttcgtccctccaagccccgtctgttccttggttggttgtgcagaagagttgctagggtttgaatccaggacggtcctgcccctgtgactcgcgggccatcttctcacctgtttgtctctgtgttcctctctgtaaaagtgggaatcattacagtaccttcctcatagactgctagggtgataaaatggagcgatgtacatgaaacctgaacgcagtgcctggtatgcagtccgtgcttagacagggctctggttttatttttatttctttttctttgagacttggtctcactctgtcacccaggctggagttcattagcataatcacgtctcactgcagcttcccactcctgggctcaagcgatcttaccacctcagcctcccaagtaggtgggattacaggtgtgagccactgtgcctggcaccattcagcaatttttttttgttttgtttttgagacagagcctggctctgtcacccaggctggagtacagtggtgcgatctcagctcactgcagtctctgtctttcaggttcaagtgattctcctgcctcagcctcccaagcagctgggattacaggcgtctgccaccacacccagctaatttttagtagagacagggtttcaccatagtggccaggctggtcttgaactcctgacttcaagtgatccaccctcctcggcctcccaaagtgctgggattacaggcatgagccatcacacccggccatcagcaaatttttaagtatacaatatagtattgtgagctatagacactattctgtacagtagaccgtaggactgactgactcatcttgtatgaccaaaactttatacgctttgaccaacacctccctgtttcccccaccaccagctccttgcaactaccattctgttctctgcttctatgagtttgtcttttttagatgtcacatgtgagtgagatcttgcagtgttcgtcttcctgtgcctggcttatttcatttagcataatgttctccaggcgcatccatgttgttgcaaatggcaggatttctttccttttttttttagacagagtcttgctctgtctcccaggctggagtgcagtggcacgatctcggctcactgcaagctccgcctcctgggttcacgccatcctcctgcctcagcctcccgagtagctggaaccacaggtgcctgccgccacgcccggctaattttttttttttttttttttgcatttttagtagagatggggtttcaccgtgttagccaggttggtctcgacctcctgaccttgtgatccgcctgccttgacctcccaaagcggtgggattacaggtgtgagcgactgcgcccggccaggatttctttcctttttaaggctgagcgatagtccatggcatgtatagatcatgttttctttgtccacttgaccacggatagacatttagttgtctccatcttggttgctgtgagtgacgctccagtgaacacgggagtgcagatatctcttcagggcccatgtgtggctgagattaggagatcactgctgtcgtctctagttcagcagtgctagtgcctcctggcgtttagcgtccagctcaagggagtggaatttgggtgtctcagggtctagggccacctgtgcctctaaatcgcagggaagctttgtgtgtgtgtgtggtggggtgcggggggctatgggtatgtggtggggtgaatcttatttctcttctttcccttttcttaattttccgttggcaaaacagagcgccactccagacccctttcattcttgcaatatacatgaaaagtacagggcttgttctgcaaaagaagagtagccccagcgagctcagggttgagtgaagttccgcaaggatggcacctctcggctcttctgggggcttcaggacagagctcagtgtcgccaagcaggacccccactgcgggcggagctgcagggccatcaacattcattaggtggatcagtgaatgtagactctgcggtgtcacaaagcagcacctgtactcactgtgcctgtctcgggatggaatctaagtcagacatccttgcatccccacttatgggctgttccttcaccttgctggtcctcacctttctcctagagttacggggaggagtaaatgtgctaaggccatacacgccgactctgcagtggccttgaaccatgcttctctgtcacccctttcgttgccttgacaatggctgcagcctcctttcccatctcccctaggatcttctcctagggtctcttaatacaggggtccccaatccccagagcacggactggcaccagttcatgcatgccctgttaggaaccaggccacaggccacacagcaggaggtgagtggcaggcgagcgtgtgagacttcatctgtatttacagccgctccccatcttttgcatcaccgcctgagctctgcctcctgtcagatcacctgtggcattagattctcataggagcgcgaaccctgctgtgaaccgtgtgcgcgagggatccaggctgtgtgcttcttttgagaatgcaatgcctgatgatctatcactgtctcccatcacagctgagatgggaccatctagttgcaggaaaacaaactcagggctcccaccgattctacataatggtgagttgtataattatttcattatatatgacaatgtaatcatagaaataaagtgcacaataaatgtaatgcactcgaatcatcccctaccctgtctgtgaaaaatcgtcttccacaaaacctatccttgctgccaaaaaggggatggctgtctttttttcttttgagatggattcttgctctgttgcccaggctggagtgcagtggcacaatctcggctcactgcagcctctgcctcccaggttccagcgattctcctgcctcagcctcctgggtagctgggattataggcacaatggcaccgtgcctggctaatttttgtatttttagtagagacggggttttaccatgttggccaggctgctctcaaactcctaaccttgggtgatcctcccgcctcggcctcccaaagtgctgggattacaggcgtgagccactgtgcctggccagggaccactgtcttaatatgtgaattaggcgatgccatgaccctgcttaatgcactcccagggcctcctgtgagaattagaacaaaaaatccatgctctgtaccatgcctccaagattggctatgtggtggcctttggtgacttctcccgcccaatcttgggtcctagctcattggtgcagccatatcctccccccaccccaccccactgtggcctttgcctgtgccatctttctgcctggtatgtgcttcccgagatctttgcacagccagctcttcctgacccttccagtctgctaggatgtcatctgcccagaccgccactctggtgcttcctgtcctgacacccctgctctttccttcacagcaggtactgctctttgtcattatgttcttatctgtgagctttcatctttgatggactatgagtcttaagaggacagagatatcgtttctgattttcccccatgcctgtgactagcccaggtctaggcatatagtaggtgctcaataaacagtcatcgaatgatagattgaatgaatgaatgcatgacaggaaccctgcacttatctgtgttaatccgtctcttggctgccgggaacaccagctcctgcaacctggcacttgggtcacctgattgaaccctcctgataactctctaaactctgtaataggtgggttctagaattagtcccatttcacagatgaagaaatcaaggcctggtgaggtgaactgacttgctttagggcagcagggatgatttttgcctctctggagatatttggcaatgtctagagacagttttgattgtcataacttgaggaggtggggagtgctactatcatctagtggcagaggccagcgacgccactcagtatcttacaatgcacaggatggcccccgacaaccaagaattatttgggctcaaataccagcggttctgaggttgaagaagccctgcttgagggcacacatctgtaagtggtggagacgggaacctagacctggaaccttgttttgttaaccactaccctgcactgctcacatgcgggggtgggtgggtgggaagagttgtagaatgtttccatgtctgagtcaaaatcttgcttctctgctctagggagatgaatttggaatctgtgaggcctgaggccattcacttgatctccggccctggagatcttgcctccaagcgacctcaggctccatctgtctgccatgtaccttgcaaacaccttagaattctggctgggcatggtggctcacacctctaatcccggcactctgggaggccgaggcgggcagactgagttcaagaccagcctgggcaacatggtaaaaccctgaatctacaaaagatacaaaaattagccaggcatggtgatgcgtgccaggtagtcccagctacttgggaggctgaggcaggaggattgctggagcccaggagatcgaggctgcagtgagctgtgatggtgccagtgtactcaagcctgggcaacagagtgagaccctgtctcaaaaaacaaaaccagctgaccaaacaaaccaaaaggccttagagttcaagcacgtggtttagaggtggtggatctcagtgtcagactctcagtgggttcaaatcctggccctgtttcttctaggttgacgagcccaagcaatttacataaactctctggacctcagagcccttgccaggaaaggggagagttttaatagtcctgactttgtagggctgttggaaagcttaaatggactgtgcttgggaagcacttaatcactgtgcctggcgtgatcactctggctgttattattggcacccaataaatacatgctttctctttgtttccaactcagcatttagaaatgtcctacccttcaattcctgctgctatttatttatttgaagtgcgaactagctttcttattattattttagaaatcatgcagaggagaaaattcaaacagtacgaaagataatacaacaaaaaatagtagttgccttcctctccctggtttcaggcctaccccctgcagattaattagctttttttctttctttttttcttttcttttttttgcaatatgaagtcttgctctgttgcccaggctggagtgcagtggtgtgattttgactcactgcaacctccgcctcctgggttcaagcaattctcctgcctcagcctccctagtagctgggattagggcagatcatgaggtcagaaatgtgacaacagcctggccaacatggtgaaactccatctgtactaaaaatgcaaaaattagccaggcgtggtagcaggcgtctgtaatcccaggtacttgcgaggctgaggcaggagaattgcttgaactcgggaggtggaggttgcagtgagccgagaccacaccattgcactccagcctgggcaacaagagcgaaactccgtctcaaaaaacaaacgaaacatcaaattcctgactgtgtatgctgcttgcaggttatatatgaccaggcctggttctgtatctgtaaaatgggttacgttatagtacctgagtcctagagttgtgtgtgaggatgaaatgtaatgtgaaacacttagagtggtgcttggctgatgcaactaatgaatcttccctcttactctttctatagacagaagaaggcggcacaggtttcttcattgcttttcgccctttgctgaaatgtcatcttggcccagaggccctttctgtctacctgataaagaactagcacctgcccacccaccattatgcttcacccactttcttcttcttcaagccatttgctcccattgggcatacatagagttgttttttttagctgttggtagttttggccgctttgcataaagtgaaattgtgtgagagtggagactttattttacttccacatgaccttggcccatggtagtagtcgctgataaatgtccactgagcaataagaacccgactgttgcaagttacttatttatttatttttgagacagggtctcagtctttcacctaggctggagttcggtggtgcagtcatagctcactgcagcctcgaactcctgggctcaagggatcctccttcgtcagcctctggagtagctgggactaaaggcaaacgtcatcacatctggctacttttaaatttttttatttgtagaaggtggggagtctcactccattgccacctctggtctcgaactcctgggctcaagtgatcctcctgcctcggtcccccaaagtgttgggattacaggtgtgtaccaccacgcccagctaagtttttttttttttttttttttttttgagatgcagtctcactcttttgtccaggctggagtgcagtggcctgatctcggctcaccacaacctccacctcctgggttcaagcgattctcctgtctcagtctcctgagtagctgggactacaggcgcacgccaccatgcccggctaatttttgtacatttagtagagagagggtttcactatgttggccaggctggtctcgaactcctgacctcatgatccgcccgcctcagcctcccaaagtgctgggattacaggcgtgaacccctccacccggccagctaagtttttaaatttttttgtagagatacagtctcactgtgttgcccaagctgatctgaaattcctggcctcaaactatcctcctgcctctgcctcttcaagtgctgggaaatataggcatgagccactgcacccagctggttgtgagttattgagatggttgaattgggagtggatgctcaggcctcagtggaacttgtggtacacagtatgtcctcattacctcccatcagtggcagttgagattcataatcactttttctgcctgttgtctgccccatcctctctgtggccttccctcctgtcctggagttggctggctgggtccctggcagggctgcatgcgttatccctgcaggcctgcttgccttatccctgcaggccctggtggagcatctgtgcagaacctgtgccatccagatgggagcagtaagggtgtagggcaaagttagtgagctgcccggtgcacgaggacttccatgataatcagggctgaaccaggaaggcaggtcaaggccagggtcatgtacagaaaggaggtcagcaccaggatcttgtatgggaagacttagatcaatgcctagtgccttagtcatcatcattcagcccagaaaacatgacgctatgcaacaggaattttatgaacacacaaaggtcaggggccactcggacttggacggggtccccaactctttgagtgtcagggctgagggcatggagacacaacttgatcaagctggtgaagtgtccagcaaggagaagcctctgttggagggagccgggagctggggaggacatgcgctttctcttttttttttttttttgagacggagtctcgctctatcgcccaggctggagtgcagtggtgcaatctcggctcactgcaacctctgcctcctgggttcaagcgattctcctgtctcagcctctcacgtagccgggactcaggcctgtgccaccacgcctggtgaatttttttgtatttttagtagagacggggtttcaccatgttagccaggatggtcttgatctcctgacctcgtgatccacctgccttggcctctgaaagtgctaggattataggcgtgagccaccgcgcccagccgacttgcgctttctctgtaaagatttctgtgggccaggttccccaaagggcaggccctgggccagtgcagtgaccggtgaccgtgttcaggactcatctcttgtggctgaattgtgtgtctggagagttgggtccttctgattctgctcagagcgtggtgggcctggctggatttccctagattaggaagcagcctcgggtagctgtgattctttgagttgggaacagcaagtggcctgcagactgccagggaatcgtcccttccttgagcctttaggtattgcccattattcaccgtttttcccagaagcctccagtagtgagagtcgcacttcttacctcctggagttgttaaagtaaagaaggacacattagggtccctgccggtaaggaacatccaggaggcctcgataccttttttttttttttttttttttccctgagacagagtctcgctctgtcacccaggctggaggacaatgacctgatctctgctcactgcaacctccacctcctgggtttaagcgattcttgtgcctcagctgcccgactagctgggattacaggcatttgccaccatggctggctaatgtattttttttttctttttcagtagagatggggtttcactatgttggccaggctggtcttgaactcctggcctcaagtgatctgccctcctcagcctcccaaagtgctgggatttcaggtgtgacccactgcgcccagtcccgatactttgtttctttgagacagtctcttactctgtcacccaggctggagtgcctgggtgggacgatcaaagctcactgcagcctcaagcccctaggctcaaaagatcctcccacttcagccttctgagtaggtgggactacaggcctgcactaccacgcctggataatttttaaatttttttggtgaagacagggtcttactttgttgcccaggcttttcttgaactcctgagctcaagcaatcctcccgcctcagcctcccaaagtgctgggtttacaggcgtgagccactgtgcccggtcctcagatgatcttagctttgtgacctatgctgttggccgctgtaggggctgtgatggaggtgatgtgggggtggatggcaggggtgacccgtgttggctgctttctgtaacagtcatagttcatggtcagagtcagatttcctctcgtcatgccttccttcccttccttctgctccctcccacagccgccctttgggtctgggctggccatctggctctgagcaggaagctagcctgtgctcttcaatttgctttctgcaggggaaacaccttcctttgctcagcgtttcctgacctctccttccctggagttccggtgtccttaaatgctctctggtttcttctgtagcttactttcttgcttgaaaggacaacttttctttgtcctttagacttcttatctctgggcaatacagtggtggtggcagtggtgattattatcaactattagtatctgctactacggtttattgtctctagactgtatcagcacctgtcacacattgtcccattgaatcctctccagaactcttccaaatgatgtgttttcctgacttttaaaaaaattaaaaaaaaatttttatatttttttgagacggagtctcgctctgtctcccaggctggagtgcagtgctgcgatctcggctcactgcaagctctgccttctgggttcatgccattctcctgcctcaacctcctgagtagctgggactacaggtgcccgccaccacacctggctaatttgttttttaatatttttagtagagacagggtttcaccgtgttagccaggatggtctccatctcctaacctcatgattctcccaccttggcctcccgaagtgctgggtttacaggcgtgagccactgtgcccagccaaaaaaatttttttaaagaaatggggtctcgctgggtgcgatggctcacgcctgtagtcccagcactttgggaggctgaggtgggcggatcacctgaggttgggagttccaggacagcctgaccaacatggagaaaccccatctctactaaaaatacgagattagccaggcgtggtggcaggcgcctatagtcccagctactcgggaagctgaggcaggagactcgtttgaacccgggaggcagagattgcggtgagctgaaatctctccattgcactccagcctgggcaacaagagtgaaactccgtctcaaaagaaaaaaaaaatagaaaaagaaaaataaaagaaatggggtctcactgtgttgcccaggctggtctagaattcctgggctccagctgtcctcccatttcggtctcccaaattgctgggattaaatgtgtgagcctctgtgcccggcctctttctctctctctctctctctctctctctctctctctctctcctctctctctctctctctctctctgtctctttctttctttctttctttctttctttctttctttcagcctgagtctcgctttgtcgccaggctggagtgcagtggcacgatctgggctcactgcaacctctgcttcccaggttcaagtgattcttctgcctcagcctcccgagtagctgggactacaggtgcatgccaccatgcctggctaatttttgtatttttagtacagacggagtttcaccatattagccaggatggtcttgaactcctgatctcatgatctgcccgcctcggtctcccaaagtgttgggattacaggcgtgagccaccgctcctggccttccttttttttgaagcaggttctcactctgttgcccaggttggagtgcaatggtgtgattatgtctcactgcagtgtctaccttccaaggctcaggtgatctcctgcttcagcccactgagtagctgggattataggcgagttcaccatgcctggctaatttttgtgtttctagtagagacgggtttcaccatgttgtccaggctggttttgaactcctgggctcaagtgatccacccgtgtcggcctcccaaagtgccgggattacaggcatgagccaccgtgtccagcttttctgactctttttacttatcaggagactgaagcttggagaaattaagtgacttgcccaagttcacatggggttaaggcctgaatttgaatctacatctgctcaattaggaagtgagtggtcatagctagtctctacctggatggattgttgtttaattgttaaattttttcaaaataattttaaattattttattaaaaaagagggtatcattatgtttcccaggctggtcttgaactcctgggctcaagtgatcctcctgccttggcctcccaaaatgctgaggttacaagtgcaaactactgtgcctagccagattattacttaacaaccaaaacaaaggaggaaattgacggtggacaagtaagaagatcattgcaaaggttgggggcaggttgtttggggagtgtggaggaagctttttaaatgaggtacctgagttggattttgaaggatgaataggagtttgttaggacagaaagacattgcagagagaggatctagcaagaggtgactgaagaaaccatttatttgaccagcagttggggaatgccttgaaggcaggaaccacagcctttcagaatctccagtgcctgcaacagtgtctagaacattatctgacaacaagcttggtaaatacttctttaagtaaatgcctgagtaaggcacatttggggaacagggtgggagaaattgtaggagaagtagatgggacttgaatgtagaaggaaggcctcatggatcactgcaagggttggttatttttttttattttttatgttttgagatggagtctcgctttgtcgcccaggctggagtgcagtggcgcgatctcggctcactgcaagctctgcctcccgggtgcacgccattctcctgcctcagcctctccaagtagctgggactacaggcgcccgccaccacgcccggctaattttttgtatttttagtagagacggggtttcactgtggtctcgatctgctgacctcgtgatccacccacctcggcctcccaaagtgctgggattacaagcgtgagccaccgcgcccagccagggttggttcttaaaagccaatagggagccatgggaagttgtttcccagcagaagagagaaggccattagatctgccctatttattaatgcaaatatctaagtctatgaatcttcctctgagcaggaaaacgtgattgcttttaaatccatatggaaagaccctcagttttactcatgataaagagaaaaggaacttaaactacacagagatatttttcacttcagattggcagaggtcggaaacttgttatctgctgtgctttgtgaagtaattgcctttgtaccttatcagctggagtatgaattgatgttccctatttggagggcagtgtctgtctaaatgttactgtaggcaccctttgacctggcaggttccttttttgaaagtttatatatatgtgagacagagtctcattatgttgcccagggtggtttcaaactcctgggctcatgggatcctcccacctgggcctcccaaaatgctggagttacagatgggagccaccacacctggcagagaaagtgatcttatcaacactcttgcttgagtgtgaaattcaattgtttattcaatgctgcattgtttgtaagaggaacaccaatgccaagtccccaggagaccgatggaagtcaagttcatccctacaatagaatacaaagcagccgtaacaaagagtgaggaaactgttcatgtatactgcgggatgatctttaaaatctgtggttaagagaaaaaagcaaagtacggaacattatgtaacgtatgcttccttcgatttgataacagaagatgtatatttactttatttttgtataaaatattttctgaaagaagacataagcaacccatgatcattgcctctagagagaggaactgaggggagggccatagggaatggaatgagaagacttgtcccttgtacctctttgttcaaaagaaatatcaagaataaaacacatctatgttactgataaagatagtttccaaaggctgtgtgcggtggttcacacctgtgatcccagcactttgggtggccaaggcgagtggatcgcttgagctcaggactttgagaccagcctgagcaacatggcaaaaccccatttctactaaaaatacaaaattagctgggcatggtggtgtgtgcctgtggtcctagctgctcaggaggctgaggtgggaggattgctggagcctgagaggttgaggctgcagtgagctatgattgcaccactgcattccagcctgggcaacagagtgagaccttgtctcaaaaaaaaaaaaaaaagttcagtttttaatattagctaagtaaaaaaaagcaaggtatagaatggagtatcgtagtgccttttgtggcaacaaaataggtcgtatttggaatatatctggaagaatgtaagatgttagcaatggtagcttgcctgtagggtagcaatggggggctgttaatttggggagaaagacatatttttcactgtatacctttttgagtaatttgaaagagttttagcacacaaatatattacctattaaaaataattacaaagagagggagacatgggtggatgcatggatggatagttggttgggtagatggatacatagacaggtggatggattggttggtggatggatggatgaactgttgggtgggtagatggattgatgggtgaatgaattggtaggtgggtagggtggatggatgaattggtggatgggtaggtggatggatgaatgaactggtgggttgctggatgggtggatgaattggtaggtgggtggatggatggattgatgggtgaatgaattggtaggtgggtagggtggatggatgaattggtggatgggtaggtggatggatgaatgaactggtgggttgctggatgggtggatgaattggtaggtgggtggatggatggatggatgggtgaatgaattggtaggtgggtagggtggatgggtgaattagtggatgggtaggtgcatggatgaatgaattggtgggttggtggatgggtggatgaattggtaggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatgggtgaatgaattggtaggtgggtagggtggatgggtgaattggtgaatgggtaggtggatggatgaatgaattggtgggtgggtggatgggtggatgaattggtaggtgggtagctgaatggatgaattggttggggggggtggatggatgaattggtgagtgggtagttgggtggatggatgcattggtgggtgggtggatggatgaattggtggatggatggatggatgggttcatggttgggtgataaatatatccatgggtatacatatggatgtgtacatagataattctctggctatgatagggaggactggctgtggtggggaacactgactgtggtggggagcactggctgtagcggggaggactcagtaggacaaggagaggctggaggcagtgaagacttaggaagcagttgcatagtcctggcaaggaataatttggggctaggatcaggtcaattaaatgtttaacattggaactatgtctcttgtatacataactgcatatgtcaagtcttggtatcgttttctttctagcagggcacattcctttggaatgagcttttactggcaactgctcagaagctgttctgtatataatgaccaccaacagtttaatccttttttcagccatcacctcaggaattaacagtagtatgaaatcaattaaaataatcagtctttgagatgtcatgccttctccacgatcaacttcttctttacaaggctgtgttccaaatacgccaggccaaaaagacgtgaactttgtcctttttagggtttgtgtcttgatgtttcctggctaaatctctttgtatgtgttggccttgtaaggtttactttttttttttttttttttgagatggagactgtgttgcccaggctggagtgcagtggtgcagtctcagctcactgcaacctttgcctcccgggttcaggtgattctcctgcctgagcctccctactagctgggattacagacgtgcactaccctgcccggctaatttttatgtttttagtaaaatataaaaattatgtttttatggggggttcttgccatgttggccgggcttgtctcagactcctgactgcctgcctaggcctcccaaagtgctgggattacaggcatgagccaccgcgcccaacctaataactagatctctttaattattggaacatgtatattttgatcagattgacacttttttttttaagtgaagtgatcttatttccctcatttctcatttttaacttttttttttttttgatatggctttaaagctctgtggagctgtaagggtctgggttccttgacactccatgggggtctcaggtgatcgtgggagggctgttggaatcagagctatttggagggtgcataggccagtaggatgggaaggctgtgggagaagtgggctttttggggaccgcagccaaatggacaactgggcctaatctaaagattggcccctcccagctcctactgatggtcatgtaacaggaatggggcccagcaccaccagattttctgatttttttttttttttttgagacacagtcttgctctgttgccaggctggagtgcagtggcatgatattggctcactgcaacctccgcctcctgggttcaagtgattcccctgcctcagcctcccaagtagctgagactacaggcatgcgccaccatgcctggctagttttttgtactttagtagagatgaggttttaccatgttggccaggatggtcttgatctcctgacctcgtgatcctcctgcctcggcctcccaaagtgctgggatgacaggcgtgagccactgcgcccagaagattttctgatttttaaagttatgccagagaccgggcgtggtggctcacgcctgtcattccaacactttgggagactgaggttggcagatcacctgaggtttaggacttcgagactagactggccaatatggtaaaaccttgtctttactaaaaattcaaaaaaaattagccaagcggggtgaccgcagtcccagctatttaggaggttgaggcaggagaatcacttgaacccgggaagcagagattgcagtgagccgagatcgcttgaacccgagaagcagagattgcagtgagctgagatcatgccactgcattccagtctgggtgacaaagcaagactctgtcaagaaaaaaaaaaataaaaataaaaagccggaaatcaaattttaaatgttgggatctaatctaatttttttaaaaacaaaaagtatgcctaaaacaacagcaataacaacaagccatctatgggccaaactgtgggtggggaaacctattttgtacttcttattttatccgattgaattgtggtggagataggaaattgagaccccaaaaagggtagtaagttttcccaaagttatttagtcagttgccagattatggcttgaattaaatttaaattcttcagctgggcatggtggtgcacacctgtagtatagctgcttgggaggcagaggtgggaggactgcttgagcccaaaagttcaaggcacaggaagctgtgatcttaccaccacacttcagcctgggcaacagagcaagacctcatttcaaaaaaagaaaaaaaaaagaaaaatttaaattcttcattacagaacagctgatggtggaggtttattcttgggcaggtacatctgatctatttatgtatgtatctatgaatttgtctatttggcatggctctttagcaaaatacaggctttttttttttaagtaaaagtaattgaaacaaaatttgtttccaaggctggacagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggtacttagaataaagcctggcatacagaactgcagtttggttgttatccgtggtggtggcggtggcggtggcggtggcggtggcggtgatggtggtggtgatggtggcgatggtgatgatgatggtggtgatggtggtgatggtgttggcagtgatattggtggtggtgatggtcatagtggggaaggtgatgatgatgaatgaagatgattagaaagtcctcagttcacaaggtcagagtgatctagatgacacagggctcttcggttataagagaatatccttcagggttcctttaaatggctctctccatctttcgtactacagtgggacttgccacaggttctggggactgttaatgtgagatgagatgctacatacctttttgttgttggtgggtttttttgtgtgtatgcactgttgtgtgtgtgtgtgtgtgtgtgtgtgtgtgagagacagggtctcgctctgttgcccagggtgtagtacagtggcatgatctcagctcgttgcaacttccgccttccaggctcaggcactcctcccacttcagccgcctgagtggctgggaatacaggcacgctccatgctcagccactttttgtgtttttcatagaggcagcatctcactatcttgcctaggctggtctcgaactcccagcctaaagtggtctgcccacttggcctcccaaagtgctgggattacaggcatgagccactgcacctgacctgtatgctcctgttaagagagctttatttttatttatttattttgagacagggtctctgttgctcaggtgggagtgcagaagacaccacatacctttatcccttgttcctcatttcttagtctttctggctactgatctttttagtttgcgtgttcatcctgaaaggtccttggatatataggagccttgtctgtttcttcaaaccccgtggcagctggtttcatgctccaggcgagctcctgtcctctggggtgtgtcctgctgacccctcgcctgtgtttgtgttcgcaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgtaagtcactggggggtttcgttgtggggggtgggaaggtgcacctggacggggagtggtggttggtgataactgacatttctcttctacttagttgaccctaagttccttcttctagaaggcagaagaataatgtgggaggtgaaaactggagctctggagacaaacatgggtacaaatctttgctctgccgcttagtatttggcctcgagcaaattttttaacctccccaagcctcagtttccctgtttatgcaataggaatgataggcttgttctcaaggcattcctgggagattatcagctcttcccctcttactgagccgatctcctttttatttaattaaatatatttatatagattttttctggccaatttttaatttattttttgtagagaggggggacttgctgtgttgcccgggctggtcttgaacacctggcctcaagcagtcctcctgccttggtctcccaaagtactgggatgctcagtgtgaaccaccacgcctggcccctaattttttttttaagttggcttttattttgaaataatttaaagctacaggaaaattgcaataatgggccaggcgtggtggctcacgcctgtaatcccagcactttgggaggccaaggcgggcaggtcaggagtttgagaccagcctgaccaacatggtgaacctgtctctactaaaaatacaaaaatgagctgggtgtggtggcatgtgcctgtaatcttagcaacttgggaggctgaggtgggaggatcccttgaacccaggaggcagaggttgcagtgaactgagatagtgccactgcactctagcctgtgcaacagagcgagactccttctcaaaaaaaaaaaaaaaaaaaaaaagttgcgatgataccaggaactgctgcctgattttctctatccatcactcatagtcactgtttcctgttttttttttttttgttgttgttttttgtttttttttgacacaaggtgttgctcttttgcccaggctggagtgcaatggtatgatcacagcatactgcaaccttgaactcctggctcaagccatcctcctgcctcagctttttgagtagctggtagctgggactgcaggcatacaccaccatgcctggctaatttaaaacaattttttgtagagacagggtctcgccttgttgcccaggctgttgtcaaactcctggcttccagtgatcctcctgcctcggcctcccaaagtgctggtattacaggcatgaatctggcctgtattcactgattttttaatcttttgctacatttgttttatcatgagcttttgttctctctctctgtatgcatgctataatttattttttctgaatcatttgagaatggatgcaccttgaaacatatcccacccgtagagggctctcagtaaatactggttgaatgaatggttgtcgtggagggctttcttgtgcagtgcgccggagttgcagctagagatgagctgtgagctgagctcttgagtgttcaggcaccggggagcatggtgaccagacaaacagtcctgttggaggtagtggggcgtagcaggctgattacagaccatcacgtgccggcctggatgccagctcaccataccgaggacttgtccttattccagtggatatgtgccatgtcctaggactgtggctgatcatttgaaggctggctggttctcctatccctggggctgagctgttcgtgcaggccctgggggaggttccagggcggtctgttgtaggatatgtatgtgcttctcttccaggccttgggatttttgctgtggatcgtctgctgggcagacctcttctactctttctgggaaagaagtcggggcatattcctggccccagtgtttctggtcagcccaactctcttgggcatcaccatggtaagtaggagctggctgtgacccctgggccatctgctgggctcagtggagaccaaaagtaataactcgtaagactagaatcatagttttttaaggcaatgatcagctggagctgggatataaattaaatgtagcctttttttttttttttttttttttaaagacatgagatctcgctttcatccaggctggagtgctatggtaccatcatagttcactgcagcctcaaacttctggcctcaagcaatcctcctacctcagacttctgagtagttgggactacaggtgtgtgtcaccacgcccagcttatttttggctaattttaaatttttctgtagaaatgggatctcactgtgttgtctaggctggtcttagactcctggcctcaagtgatccttccagagcactggcattataagcatgagccactgttcccagccccagctgcagtctttggatggggcatgtgttgtccagtttgccacagtccccaccatgccctattgtcttccctgccactgattgagtggcagatgcccccttttgttgcgtttgccacactttgctcttgcattggctactttggtcacttatatactaactgcctggggtctaatggccttgagttttcactatctggcatagggggtgggttgctaagctaaataggaaactgctctgtcccgggggatacacaacttagtgagtgacagagacaaggaaacaactttattaattacagctggtgtgtattgagcacttactatgtatgtacctggcagtattcttggtgtttcacgtgtcttgaaattcattgaattttcacaacaaccctgtgagatgggtcctgctttgttcccatcttacaggtgaggaaaccaggcaagagaggttaagtgtcctgctcaagatcacaccactaatgtgcagccgagtcaggggtgggaccccagatgccatgcttttagcccctgcaacctgcagcttctgagccctgaacagagagttctcggagagtgtagcccttgagtattgtaaaaagaggagggaggctgggcatcgtggctcatgcctgtaatcccagcactttgggaggctgaggcgggagaatcacttgaggtcgggaatttgagaccagtatagccaacatggcaaaaccccgtctctactaaaaataaaaaaattagccggcgtggtggcacacgcctgtagtcctagctactcaagaggctgaggcaggagaattgcttgaacccgggaagtggaggctgcagtaagccgagatcgcaccactgtgctccagtctgggggacagagcgagacctcatctcaaaaaagaaaaagaaaaaaaaaaggagagaacaagtttaaggcaggacattctgagcagggtgaacagtgtgtccagggaggggtggaaggttaaggggaggatgcaggcagggaggacaaggtgttcggtgaaggaacacggtgtgaaggttggggggatagagtggatgtgacagaggggtcaggaaagacaacgtggagccaggttgccaaggaccatgaatctttatttttctaaattaatttttcattttttaaattttagagtcagagtcatactctgttgcccaggctggacttcactggcgtgagatcacagctcactgcaggcttgaactcctgggctcaaatgatccttctgcctcagcctcccaagtagctgggagtgtaggcatgcaccaacatgcccatctacatttattttttatttatttatttttttatttttccccccgagatggagtttcgctttgttgcccaggctgaaatgtaatggtgtgatcttgagttgccgcaacctctgcctcctggattcaagcgattctcctgcctcagcctcccgagaggctgggattacaggcatgcgccaccacgcccggctgattttgtatttttagtagagatgggatttcaccatgttggccaggctggtctcgaactccggacctcaggtgatccacccacctaggccccccaaagtgctgggattacaggcatgagccaccacccccggccagtttgttatttttgtagagacagggtctccctatgttgcccaggctggcctcaaactccttgtctcaagtgatcctcctgtctgggcctcctaaagtgctaggattataggtgtgagccaccatgccctgcccagaccatgattctatatagcacacatatgtgctgtccactctctgccaagaactgtcctaatccctttattaacccttttacgttgtaaataaggtaagcaaagtgtggtacagagaggagaaggactggcccaaggtcacctggtcagtaagtggtagagccagcttccagtctaggccccagcgtgtagcctggcacctgctttacgcctggctctcctgctgggtttgattcccctttgtgtcctcagagcctggccctgtgcctggcatgcagtaagcgttccataaatgcatggagggaatgagagagtaaagggctttgctttgtcctgaattcgggtcttgggctctgtgttctggcagtggggtattagagtggatttttttttttttttttcaatttcactataatagagacagggtctttccatgttgcccaggctagtcttaaactcccgagcccaagtgatccctctgccttggcctcctaaagtggtgggattacaggcatgagccaccatacgtggtcagctgtttttgacttgagtaggtcatcctcccttaacattccttgttcctggtcttttttttttttcctttgaggcagagtttcgctcttttttcccaggcgcaatggcatgatcttggctcactgcaacctctgcctcccgggttcaagtgattctcctgcctcagcttccccaataactgggattacaggcacgcgccaccacacctggctaatttttgtatttttagtagagatggggtttcaccatgttggccaggctggtctcaaactcctggcctcaggtgatccacgtgccttggcctcccaaagtgctggtattacaggcgtgagcaactgtgcctggccgttcctggtcttttgatcgttcatttatgcctctgtcaccctgggggaaacaggggtgatagtctgagggttggggcttttgactcctcaggggactctgagctgggctggccaagaggtgaactggcctgtgagatcctcagcctctctttatctacctgagatctctgggatggaatggaggaccaccagctcagctgtgaatgtgtcagaaacattctgactatatcccagggaaccaggatatgcaggcactggtaatatgggacaggatgcagccagcacatgttttttttttttttctttgagatagcgtctcactctgtcgcccaggctggaatgcagtggcatgatctcagctcagtgtagcctccgcctcccaggttcaagtgattctcctgcctcagcttcccagctagctgtgactaaaggcgtatgccaccacgcctggctaatttttgtatttttagtagagatagggtttcaccatgttggccaggctggtctcaaactcctgacctgcccgccttggcctcccaaagtgctgggattacaggcatgagccactgcacctggctgatttttttttttttatccctactctgtatcaagcgttggagacacaaccatatagtctagctgtgcaaacagacattaaacaaatgattcctcaaaaggcacaaagtgtttgaacgtctgcagagtgctgtgtgagggtgaaggcaggggagcttggtttggtctggggcatagccaggcttctctgagggagggatggtggaggtgaagcctgagaatgagcaagttgttaaaaagcttaaggggctgagggcagaggaccagctgcggagaaaagcacatgtaaagtcctgagggtcacagggaaaacttgagagttgtgtgtggctggagcagagatggccgaggcagagagcaggggcgatggggcagaggctgaccccgggaacgttgagcatcagggcaagtgggttttgttttctgtactgggttctctgcctgttcttttaaataaagttttattggcatgaaggcatgtccattcattaacatcttgtctatggccactttcacactgcagtggcaaagctgagtagttttgatgtagtctatggcccatgaagtccaaaatatttattacgtggtccattaagaaatagtgtggctgggagcagtggctcacacctgtaatcccagcaccttgggaggccaaggcaagtggatcacctgaggtcaggagtttgagaccagcctggccaacgtggtgaaaccccgtctttactaaaaatacaaaaattagctaggcatggtggcgggcacctgtagtcccagctacttgggaagctgaggcaggagaatcacttgaacctgggaggcggaggttgcaagtgagctgagattgcaccactgcgctccagcctgggtgacaagagtgaaactctgtctcaaaaaaaaacccaacaactcctgtcttgtgcttctctcctcagctgcttgctacctttttaattcagctggagaggaggaagggagttcagtcttcagggatcatgctcactttctggctggtagccctagtgtgtgccctagccatcctgagatccaaaattatgacagccttaaaagaggtaagtggcagtctccttcctcatcttccttcagtggacccggagggagagatgctgggtccctctggcttgtgtagaagtcatgcgttgccatgggaaccaggggctgggtaccacatgcacctagcttctcccttggtgactttcctaccccaccaaatcctcactaaatcagccccagccttttttctagcacctcctttccccagggcctgatttgtctgtgttgctccaaggggctcccatgggacctccaagggcaggagctgtgggccgatgccaggctggccccatcagcaggaaacagcaagacaggcggctccaaattttgccaggctgggatggagccgagccgggaacggtgtttgcagagtgactgttcccctgggggaccctaggcttgtcctcgcgttacctttgtcccatcagttgctgctctggctggggaagttgtttacattggctgctgtgtgctgctgctaggaattttgaggagtgtgcacttttttttttttttttttgctgttgttgaggcggagtctcgctctgtcaccaggctggagtgcagtggcacgatctaggctcactgtaacttctacctcctatgttcaagcgattctcctgcctcagcctccccagtagctgggaccacaggcacgcgccaccatgcccagctaatttttgtatttttagtagagacggggtttcaccacgttggccaggatggtgtcgatcacttgacttcgtgatccacccgcctcggcctcccaaagtgttgggattacaggcgtgagccaccacgcctgacctggagtgtgtgcttttggaataacctgctgttcctgccatcttggagctaattagagactggcatgaggcaaaggaaggaaaagaagctgaacatttgactattgattgcctacatattattatgagtgatagcagctgatgctgattgagttcatgttttcaaagtgcctcgcaggggactgtgtatgtgtcacgaataatcttcctgacctcttgcagtgacttggacagaatttctcagcctcagcactaatcgacattttggattggagactcgttggttgtaggggctgtcctgtgctttgtagacatttaggggtgtccctggcttcccctgactgggtgccataacactcccaagttaccacaaagaagatatccccagacactgccagatgtttcctgggaggcagaatcacccctggttaagaaccaccggtggtttataggtggggaatctgaggcacagaaaggttaaataagttgacaagatcccacagccagtgtgagagagccaggccttgatacagctctgtttcactcccaagccctgtcttcctcccatcaggcagcggtgagcagtgagactacccgtgatggagccggctttctgccattacatcccggggggagctgggagcccctggggagcctgcagtgtccctgtggctgagtgggtttctgccacctgctctcagaatgtgatcttggttttttttttttttttttttttgagatggagttttgctctgtcacacaggctggaatgcagtggcgtgatctcggctcactgcagcctccgcctcctgggttcaagtgattctcctgtctcagcctcccgagtagctgggattacagttgcccaccaccacgtctggccaatttttgtatttttagtagagacggggtttcaccatgttgaccaggatggtctccaactcttgacctcaggtgttctgcctgtctcggcctccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgggggagctgaaggagagaatctgctttgtcattgatgaactgctgtcttgcaggcctgtaggtttctcacttggcatggtgattttggaaaatgtgagcagataattacaaatcaggtattttttatgaattctagctgtccagatgttctggaaaagtaaagttctgacagattaggcctataatcctacagggcagagctgaggagttgctggagtccccggcactccctgttgtattatactggcatgctttcctcacttgtggcaaatgcctggcccctgagggatttgagtgtgagatccttggtctattttgtcagtttcagagaaattctgtaaatatggaaacttatcagtgaggagtgtagagatggccaccgtttctgctagtagaacaaaagggaacactttattaatttcccttaattcttttcttcttttttttgagacagggttttgctctgttgcctaggctggagtgcagtggtgtgatctcggctcactgtagtcttgacctcctgggctcaagcaatcttcctacctcagctttctgagtagctggaattacaggcacacaccaccatgcctggctaattttttttctttcttcaacttttattttaagttccagggtataggtacaggatgtgcaagttcgttacataggtagatgtgtgccatggtgatttgctgcacagatcaacccatcatctaggaatcaagcccaggatccattagctattcctcctgatgttctccctacacctgctccccaacttggcttacttttaattaattaataattaaagatggggagatggtctcaaacccctgggctcaagcgatcctcttgccttggcctctcaaagtgctgggattacaggtgtgagtcaccacgcctcgcctattctttatttttttaaatagagatgggatcttgctgtgttgcccaggctcatgtgcagcttttgataagagagatctgggaaggcctgcccagaaaactgcatgtgagcggagacctagaggggtgaggtagtgggtggagcaaacacctagaggaagagtgttccaggcagaggggaataagtacaagggccctggggtggggaggtgtggagagaacagcaagaaaagccagcacagcaggagaaggctaagagacagtgggtgcctgagaggtgggacagcccccttgtgagccagatgagctgtttgggttttattgtgagtatggggcagggaggccttggagcacctatttgatgctgattcatggctagtcagctggtaatgggcggattgcagtgggagaacttttcacctctgtggttctgttgggtttggcctaaacctctgtgaggggcagaggctcaccttgtgggtgacgaaagggcttggtgggcatcagtatggaggaggaggttgatgataactaagagattttagaaacctatgtctcaggccaggtgtggtggctcacacctgtaatcgcagcactttgggaagctgaggcaggcagatcagttgagttcaggagttcgagaccagcccagccaacatggtgaaatgccatctctgctaaaaatacaaaaattagccaggcatggtggtgcatgcttgtaatcccagctagtcgggaggctgaggcaggagaatctcttgaccctgggaggcggaggttgcagtgagcagagatcacaccactgcgctccaacctgggtgacagaatgagactctgtctcaaaaaaagaaaaaagaaatgcatgtcccagtgtatgttctgaggagtcccgtgttggtatttccttgcccaaagaggagctgggttggagaaatgagcaagtgcacacatctgtgtatgtattcctgtgcatctgtgtgtacgtgtgcatgtgcctgcttgtgtgtctcggtagtcataggcatgtatatgcgtgtatgtgcttatatgtgaatgtgtgcttgtgagtgtgtttatgttcatgtatgtgtgtgtttgtgtgtgtgtgtgtctttgtgttgtgtgtgcttgcatatgtataaagttcacaaaggcaatggtgactcatgcctgtaatcccagcactttgaaaggccaaggctagaggatcgcttgagcccaggggtcaccccattttggatccctggctggtgcctgacacagaagagaggggctcatgagtcagtggctgttatatgtattgtgtatcagtgtgtgtaagtgtgtggcagccgagtgtccctgtttgtcaaatgttgggctattcttttttgtcttttgtttgttgtttttttctgttgttttgttttgtttttagacggattcttgctcttgttgcccaggctagagtgcagtggcatgatctcggcccactgcaaccccgcctcctgggttcaagcgattcttctgcttcagcctcctgagtagctgggattacaggcgcccatcaccatgctcgactaatttttgcatttttagtagagatggggcttcaccatcttggcccggctggtctcgaactcctgacctcaagtgatccacccgcctcggcctcccaaaatgttgggattacaggtgtgagccaccgtgtctggccgagccattctttagaactgggatttatacaaaacaagtcacacctcaactgggtggctgcagaccttggattgctcagggtaaacagagtctggttggggctgcctggctggcgtggggatcacccaacccatcaagcttcctctgggagcctgggaagagctctcttgccatggatggttctggaagctttttgaaggagggactttcttaatttctgatctcccttgggaatctggataaattccctttcacttctcccctgggcgtgtgtgtaccagggtgactcacagatctgacttggacctttttttgtgctttctgcattcctggcagcctgggcctgggatttgctctgccaccctgggtgacatgaagctctcagctctggcggctaaaaggctacactgttgtggggctgggacaccctgactcttctccccagtcattgttttctgtttctgtgtcatctcccccagctcggctcctcctgtgtcactgctggtcttccaagatggtggaagacactgtggtttgtctctttgcagtctcgctctgtcgccaaggctgtagtgcagtggcatgatcttggctctgcagcctctgcctcccaggttcaagcaattctcctgcctcagcctcctgagtaactgggactacaggcgcacaccaccatgcctggctagtttttgtatttttagtagagatggggtttcaccgtgttggccaggatggtctcgatctcctgacttcaagtgatccgcccactttggcctcccaaagtgctgggattacaggcttgagccaccgtgcccggctgtggtctgcctcttgtgcagtgagatccagcagggtgtcaaatgtgggtgtgcaggctgctgcatttctgacatttgtgcacctgtccaggagagaacactttgattggctgacactctctgtccaggaagcctgaacttccctctgggttcctgttcaggaaccccatggggttgccatttacctttttgcagattagagtttagaccaggagttagccagtagcccatgggccgaatctggcctgctgcctgtttttgtaaataaagttttattggaacacagccactcgcgttcatcacatagtgtctacaggtgtctggagctgcagcagtggagttgtgtagttgctacagagactgtagcacccacaaagtctaagatacctaccatctgaccctttacagaagaagtttgtccacccctggtctaagcatttctttagctctgatgactttttagcttccttttttgtcccctttccatttgcaggcattctttcttcctatgcaaggcaaggacgggaatcgacatttattagatgcttgcggtgtactggctagcactatgctaagttctttatatgcatgtctcacttgactctcacagcagtcctggtgaacttggtactatttttctcattttacagacaaacaatcgcagacataagtgccttgctcgacctgagtagtagagcagagattcgaactcacgactggctgttgtgcacaatcatgtcacttcgcttggttgtaactgctgaatgggagggtcttggctaaataatggctttgtgttaggctagaggcttcacgtggcagtatccaccttgtaacctcagtgcctaagacacagccaggcacacggtgggcctgtagtggtaatttattgttgtgttatatggggaggtgctcagtacatgtggcacgtatattatgtcttgcataagggtgaagtgtgcatgaggcctcacaggacatcagattaagctgcttctctgccttcatcctgttcaagtattaccagcaagaaagaggaaggggactgatgtatgcacagatgttctgaaggcttggcatggtgtcaagagccttatttttttttttaatgttgcattttggggggttaaatatatgtaacctaagatttgccattttaaccattttaagtatgcaattcagtgatgctaagtgcttttaaaaatcttgttcaaggccaggtgtggtggcttacacctataaacccagcactttgggaggccgaggcaggtagatcacctgagatcaggagtttgagaccagcctgaccaacatggtgaaatcccatctctactaaaaatacaaaaattagctgggcatggtgttgagcacctgtgatccctgctatttaggaggcagaggcaggagaattgcttgtgcccgggaggcggaggttgcagtgagctgagatcgctccagtctgggcaacagactgagaccctgtctcaaacaaacaacgaacaaatgaacaaacaaacaaacaaaataaccacataactacctagcaacgtagcctagcaattgagatgggggcaaggaagggtaggaaccaggtcctgtgagaatcagctagacttgtggctttgggctcggtgctcttcctttggggacgtcagcagccccttcttgaaaacgggttgcaactcgatttgttgttggcttcacctcctctctctgtcccagacctgagccctgtgatctggggaggaggacaacgggacaacctgtttgcttgttttcccatcactctcagggattgaatcacagtggagccaggaagatggggagagtccaggcttgctgctctcccatcctcagagcagcagcaggccatccatcacctgtcgcctgtcctcagagtgatcagccaaggcctggggcggctggggtcaggtcaggcagggcgtgggtgggagctggcagggctggctcctccaggccacttcgtgctgagtcactgagtcggccaatcctccccagctggccctgctcccactccatgactcagatgtctattccagccctggctgcttggtggggctcctcccatctgtccttctggctctggggctgccgaggcttttgggagcctgggcagggctgaccaagactgccagagctccggccggtccccagtctcctgccttttttctcattggcactgagtctgtggtttaggtttgggggaggagggtcttgtagataaggggatcaaggccaaaggagatcatttattaggtcccagctgaaagcagaggtccttggaccagttggaatgctcgacatcccccggaagcttgctagaaatgctgggtctcaggcctcatcccagacctaccaagtcaaactcattttaacaagatctccaggtggttcagggttgcaaatcactggtttggaacattcagtgaaagctactcagctcgtttgcagtaagaggtatttttagtcctgtctgtataatatgtaatattttccccccagcattttactatgaacattcttaaacctacagaaaagtcgaaagaattctactgtgagcagtcatatagttggtacctagagccacagttaacattttgctaaacttgctttgtcacatatctgtctgtctaaccagatagctaatcagccagccaaccggctacttttgttttgttttttgtttttgagatagggtctcactctgtctcgcagactagagtgcagtggtgtgatcatagctcactgcagcctccaactcctgggctccaatgatcttcccgcttctgcctcccaggtagcttgggccctacaggtgcacactactgtgtttggctaatttttaaattttttgtaggcgtgagggctccttatgttgcccagtctggtcttgaactcctggcctcaagccatcctcccacctcagcctcccaaaatactgggattacaggcctgagccactgaacctagtttttttgatatctgaaacttccttcgaaatatattagtattctttcatgcacccacttccaagtaaatcattagctagagtttaagatctgtttacacttctgagttttttgcttaaaatttacatacagtgaaattgctgatctcaagttagcatttgatgaatcttggtaaaggaatactttaaacccctgtcaagatatagaacactgcaaggacgccaggaagttccctcgtgccccttcatgatcagtctctgtccccacccaccaaggcctgatcttggaccgttgattaaagcgttgaaactccattttctttccatttctccgtcatgctttcagtcatttaataatcaggtgttgtgccaggggctgagctagaaagaaacagaccttgaccactgccctggaggagagatggaaggtgggtggcaggcagttgaaccaacaactgcaggatggacagtgggggctctgagggagggaagtgctgggagttgtgggggctgggagagtggtccctgactcagcctggggctccagggctagcatccagggaggagaggggatgctcaagtctaaggaatgcgaggctctggccaggtgaatatgtttggaggtggtggggtgggagggtgctcctggtagagcaactggcatgtgcaaaggtccagttgagggagcttgtgggtgttgggaatcacttggaattcggcttggctaggctgggtgcagtggctcatgcctgtaatcccagcactttgggaggccgaggcaggcagatcacctgagactaggagctcaagaccagcctggccaacgtggtaaaaccccgtctctactgatcataaaaaaattagctgggtgtggtggtgcatgcctgtaatcccagctactcgggaggctcaggcaggagaattgcttgaacccgggaggcggaggttgcagtgcgccgagatcgcgccactgtactccagtctgggcgacagagcaagactctgtctcaaaagaaagaaagaaaaaaagaattctgcttggctagattggaagggctaggatgtaagcgaaaagagaggcaagagtcagcatcagagatcaagggtgcaattatgtgtcacaataaggacttggaattttttgtttgtttgtttgttttgagatggagtttcactctgtcaccaaggttggagtgcggtggtgccatctcagctcaccgtgccctccacctccggggctcaagcgatcctcccacctcagcctcgcaagtagctgggaccatagttgcgtgccaccacgcccaagtaactttttctgtttttggtagagatggggtttctgtatgttactcaggctggtcttgaactcctgagctcaagtgatgccctgccttggcctcccaaaatgctaggattacagggatgggtgaaccaccacatccagccaggacttggaattttaaccctactgtggtgggagctgaggaaaggtttttcaccagtggaatgacacactcaggttggacaggttgtggaagatcctcaggctcaaaggaagaggatacattggacatgggggtgaggtcggtggcacttaaaaagcctttgcaggcacccaggcaggtagagagggaggctgagccaggatattcccctgtgcccactacagcatcaaaaaccagaaaaagggccaggtgcgtggctcacacctgtagtcttggcattttgggaggcttaggggggaagatttcttgagaccaatctggtcaacatagtgagaccccatctcttgaaacaaaaaaacaaagaaaacagacaagttgatgggcaaagggcatgggcaaagattctggggtgtgctccagtagaggaaacggaggtcctgggcagggaggcattttgcacagttggtaagcaacagggcaaacaaatcaccagtgtttacgttatactggcaaatctcttactgctggacatttaggctccgtctaataataaggataacagctgggtgcactgtattatttatttagtcctcacagtagggcaggatgatcagtctccccacttgacagatgaagacactgagggtcagagtggtgatgtgtcaggaaccctcccactgggttctcacgcttgaaacacagattgctggtccccacccacacagtttctgatgcagtaggtctgggtggggcccgagcatctgcggttcccaacaagttcccaggtgccaccgatgctggtgacagagctgcgtttgaggatcactgctctaaacattattgctgctgcacgcattgcctcctgctgggtgcaggggttgtggggggcactttggcagtgcagagcggaggtaaccagcagaaaacccgttagaactaaaagctgagagtgtttctgacaaacaggtcaacatgctgaaagacccagacaaggtccttaaactaccctgcgctccaagaatcagtgcctggggctgccgtacctaattggttcaaaccacagggtttctggccagctcatctggtaccaaacgtagatgtcaatatggtggatgccaaagaacacatcactctgtttggatgaatcaggcttttcctccctctgccttcagccaggacttctctgaattgttttcatttcaaatgaaagagggaccagttcacaagctgctttcatgctatctgggacaggagttactgtatttcagtgtctgaggctgggaaaccccctggaggtggctctgtcttttgtacctagtgtgtgatgtcaaaagattctccttggtttgggttaaatgacatgctccctggattacaatccagtgccccatgattttttttcctccttttttattgtcaatccttgacctacttcagaagttagttgtctttgttgtcaagtaaggccttccacgtcagatagaggctgtttccaggccgggtgcagtggctcatgcctgtaatcccagcactttgggaggccgaggtgggtggatcgcttgaggtcaggagtttgagaccagcctggccaacatgataaaacccccgtctgtactacaaatgcaaaaattagccaggcatggtggtgtgcaccatgtaatccccgctatgtggcaggatgaggcaggagaactgtttcaatttgggaagcggaggctgcagtgagctgagaacgcaccattgcgctgcagcctgggcgatgagagtgaaaccgtctcaaaaaaaaaaaaaaaaaaaaaaaggctatttcctttttttttttttttttttttttgccagtgaaggggggaccctgtgttggcctccctatcggtcacttgagataatctgaaaatctgtgtttagatccatagaagagaggcggcctgaggagaagaatttgacaaagctctttgagtgtgcaaattagaaatggcaattgctgggcgcggtgggtcatgcctgtaatcccagcgctttgtgaggccgagataggcggatcagttgaggtcaggagttcgagaccagcctagccaacatggtgaaaccccatctctatcaaaaaatccaaaaattagccaggtgtggtggcagatgcctataatcccagctactcaggaggctgaggcaggagaattgcttgaacctgggaggtggaggttgcagtgagccgagatcgggccactgcactccagcctgggcgacagagtgagactcagtctcaaaacacaaaaaacaaaaaactgtgcagtgttctgtctgtcaatgtccttgttgcatttgcagggcaggttttctaccagtggctggggacttagttttactgggccgagggaaggttaggatttgagggtcttgttaagctggatatgggctgcatttcaagcctcccctggctgtctctatcctgcgtgttgatgccaaggctgaagaagactggatttgcaggcaaaagactgtcatttgaggcctgttttcaccccttaatcactgtgtcttggtatgttgtgggggttgaggtaggcagaggttagccaaccttttctggaaagggctggctgataaatacttgaggctttgcatcccatacactgtctgtggcaacccctaactccgctgtgtagctcaaaagctgccatactcatttataatacataaatgaatgggtgtgactgttccaatgaaactttatttataaatagctggtctgtgggccatagatgcttctgatatataaagcatctggtatagtggtgtattgtgaacccactggggttttttcccccccaaacacttgagctttattgatgtatattgacaaataaaaatggtatataggttgggcacggtggttcatgcctataatcccaggactttgggaggccgaggcaggtggatcacttgagctcaggagttcgagactagctcaaggaatagagtgaaattctgtctctacaaaaaatacaaaaattagctgggtgttgtggtgtgcgtctgtagtcccagctacctggggggctgaggtgggaggatcacttgaacctgggaggtcgaggctgcaaagagctatgattacactaccgtgctccagcctgggtgacagagcgagaccctgtctcgaaaatatatttaaggtgtacagttttatgtttccatataccagaggctactgtcactgcttctattattattactactactactactcatgttaccctttctttggctgttactttgtgccaggtactattctaagtacttaccatgtttgatctcatttaatcttcaccaccaaggaactgacccaaggtcccacagctaggaaatggcaagctgggattgagccgtgccagctagccccgtgctatgcactgcttcacacagaagctgcccctccacccctgccgccttccttttcctttgttcctttgttatcagctggccgtttccagaaacggttggttaacctctgcctacctcaaccctcagtgattaaggggtgatatcgggcctcaaatgactgacctttttcctttgttgcagctctcactgattgtaattctgattgtaattatatatttgtttgcaccgtggtttacttactgtccatcttccccagggcaggaggctgaatggggcaggggtctcgctgtctcgtttgcagctccgtccgcggcacttcacccacatcctggcctataagcaagtcctgcccatatatttgaccaataaataaatgaatcattgacagccgtgccccaccccttcctcctctctctgccagccagcaccttggtctttcacagtgggtagagggcttgggctgcaggtgaaatggatttgcaattccctgataacccacccgccgactgtgggagtgggcaggaaggtgtcagctcttccggatgaaaaaccagcctgcaatgcagtgtttctacccagcctacaaagcaaacaccactacctccacgccttaggttggagaaattccgctttacgacacagtcccatgggcctcatgtcatttgtccctcctggcagtcccgggggataggtcgagcaagcagtaggacaaacgactcccattttccaggtgtaaaaactgaggcttggaggtgaagggacttgcccaaggtcatcagctagaatatagcagggctgggattagaacccaggtctgtccgggtccacggtctgatctgaactcggcttcagttggtctggaatgcaccggctgcatctgatgatcttattaaagatctgtggctgtcagggtcctccccctggaggtgctgatttagttggtctgggttggggccctaggcacttggcacttaacaaactccttaggtgattccagtggacaggcagggctgggaacttcatcacccctccgagccccagagcggagcctgatccttagccctggctgtgtatttgaatcactggaggagctttttatttagccttttatgatggaaacataaagtagacagcctaggataatgaactaccatgagctctttttcttttctttttatttatttttgagacagggtctcactattacccaggctggagtgcgatggcacaatctcagcttgctgcaacctctgcctcccgggttcaagccattctcgtgcctcagcctcttgagtagctgggactacaggcacgtgccaccatgtccggccaatttttatattttttgtagagacagggtcttgccatgttgcccagactggtctcgaactcctgaactcaaagcagttctcccgcctcagcctcccaaagtgttggggttacaagtgtgagccactgcgcccagctgccatgagctctttaccatgcattgcataggtgaacgttttaatatgtatctctgaaggacatggatttgtttattttaaatgactttttatttcgcaatagtttggctcacaaaaagttgcaaaaataacagagttcctgttgttcattgctcaactttctctaatgataacatctgaaagataagaattttaaaaactgtaactgttgggctgcatgtgatggctcatgcctgtaattccagcactttgggaagctgaggcaggaggatcacttaagcccaggagtttgagaccagcctgatcaatataggtagaccttgtcttgacaaaaaacatgtatatgtgactgtaatactaactttaataataattcattattatcaaatattccagtaatccattgtgtttgtacaatggctcattcttctatgatatcattctttatgttttagctgggatttttttatggaaaagagtttccccttcatttctttgatcactgatcactctgtggtgatcgaataaatgactgttttcctcagggaagccttctccaaccctggtgaaccaaatgagtacatttgggaaaggtggagaaaatacttgtttctttccgctttttctgcgttcaaacaatgacctggttcactgacaacatcagatgtttctctttatttccagcgtcaatatgaaatttgtgtacataaacatgtaaggctgggcgcagtggctcaagcctgtaatcccaccactttgggaagccacggtgggcagatcacttgagtcaggagttcgagaccagcctgttcaccaacatggtgaaaccccatctctactaaagatacaaacattagcccagtgtggtggctgatgcttgtaatcccagctacttaggaggccgaggcgggaggatcacttgaacccaggaggcggagtttgcagtgagccaagatcacgccactggactccagcctgggcgacagagcaagactccatctcaaaaaacaaaacaaaacaaaaaccttgcttggtatgtttcagcctgttgtacttattctccttgtcaaagctcaaattgtccctcttttagcctgcagcggccacttctgcttggctcttgagccttttaacaatcctgttcatgcttagtttccttgttgtccggtgtgacaagatgttcttggcttaccttgcatatttcctgcccagccacttttccaagaaaaatctggaagtttaaaacaaaaacaaagcttcagtgccccagtcgcacccagaaccagcttaatcagattgcctggtgcgggtagggcccggatacagtatttttttaaattttatttttattttgtttgagacagggtccctaggctggagtgtagtggcacgatctcagcttactgcaacctccgcctcatggattcaagcaattctgcctcagcctcccgagtagctgagcttgcaggcacccaccaccacatccagctaattttttgtatttttggtagagacgaggtttcatcatgttgcctaggctggtctcgaactcctgaccacaagtgatctgcccgccttggcctcccaaagtactgggattacaggcatgagccaccacacccagccaggatacagtattttttaaaaagcacgcccagccttgaatggaaaaccactggacgagagtatgccaccttatcgggctctgtaaatgccttatatctgcacaaggctggaactttgagtggagtccttggctaaagctttcattactgcctggtgacctctcttccctctgctgctaaagcttgtgtttcagaatttagacccggatgcatccatgttgaaagccaggctttgtctgtcatcccaggagctctgtatcggtccctttccttgcctgcatgttgttgacttggggctcatcttcatttctctgggaaatgagttctttgatagcttgcttagaatctctcagtacttcccattgcccttagaatgaagaccaaaatatgtggcctgcagtgtagactgtgcacagcctccagtgtagactactcaggccccttcttggttcctggagtctaccatgctttcttctaccaccgggcctttgcacacactgctgtctgttgggaatgcgttgcctttccttgttacttagttctcatctactcacccttcaggtgccagcttgactgtctgcctcgggggcgccttctctgaccttcgtacaccagatcagcccccatgcacttactttgtctcattggtaatatttctctcccttcaggacacacatcaaggcccagaagttgtagttttgcatttgttcatgtgatcatttgatgcatgtctctctctggagcctgactctttggggctcacatcctcactccaccgcttttagctgtgggaccttgaacaaatcttttcatctctggtccccagtttttaagttaaattaaattttattttatttttattttgagacactcttgctctgttgccaggctgtagtgcagtcgttcgatcatggctcactgcaacctccgcctcctgggttcaagcgattctcttgcctcagcctcccaagtagctggaactacaggcgcctgccaccacatccagctaatttttgtatttttaggagagacagggtttcaccatgttggctaggatggtctcgatctcttgacctcatgatctgcctgcctcggtctccgaaagtgctgggattacaggcccagtttcttttaactgcaaaacagggatgatataatacttttatttatcttgtgaggtgaggatgaagattaaataaggtagtttgtgtaaagcacttagaaaagagctagctactaatagtagagaatcttggcaggtattactgatgattactgcagtagaccacaagctccatacaggcaggggtcatttctgtttgtttagatttgtatgcagggtgcttggcacaagggttgtgctcaggaaatacttgttggatgaacgaatgaatgaagtggagataatagtaataccatgtttatagaattccatgaggatataaaataatgcaagtatataagctcttggtagagtgtctagcacatagtagatggtcaataaatattcagtgactgaatgagtaaagtggggacaatagtaatacccgctcatgaggttgtcgtggggatataaggcaaccctgtagtaccttgtagaatgcctagcacatagtaggtgctcagaaaatatttgttgaatgaatgagtgaagtagggatgacgttaacaccaactcctagggttgttgtggggatagaagacaaggcaggtctatagcatgttgtattgtggttgcacatggtagacactccgttgattgaaactggaagagctgccatgaatttctttctcctggctattaggagagggtccttttggggtgcagaatggtgtggagctgacgctagtcctctggaaggaagagtgagcagctgactacttgctaagctctgacctggatgaaaagtcaaatcattcctttccctcttcctcccaaacctgtgctttctttccactagaatccctgcccagagtccagcgcttccttcctgtcgaggatcaccttctggtggatcacagggtaaggccaggccccccagacctcagggaggtggtggggagtgaatgaatgaatgaatgaacgaatgaacatgctcagctccccctccccaacttctccctcctttgctcttctgcagagttgtcttgaatctgcctgtgctggccatgtggtctcagagacaccaactctgtccggcagttccgtgaacttgaatgtgataaacacgtgagccgtgagcagctgacacctctgcagaaggctttgcctgggacagccatatgctggactgcttttgctttagcttcagatttgggtttttaaaatattaggtatagttattattgacattgtccccctcctgtcccccacgccttagaaaaataatactgtctcaccacaggaagtgtgggttaaaaaaccacatgtgcagatcagcagtgcaggagacatctagaggtaaccagtgtcaccattttagtatgccttcttctggtcgtctttcttttttttttgagacggagtcttactctgtcagtctcagctcactacaagtctccgcctcccaggttcaagcgattctcctgcctcagcctcccaggtagctgggattacaggcttgcgccaccatgcccggctactttttgtatttttagtagagacagagttttgccatgttggccaggcttgtcttgaaactcctgacctcaggtgatccacccgcatcgacttcccaaagtgctgggattacaggtgtgagccaccatgcccagctaccttctggtcctctttttgtatatctttttctgcccgttgttaacatcttagtggggattgtttgaagaatctttttttgcccctaataagcatcatcttttttttttttttttttttttgagacaggctttcgctctgtcgctgaggctggagtgcagcggcacacttgtagctcactgcagtcccaatctactgggcttaggtgatgctcctgcctcagcctcctgagtagctggggctacaggcacactcccccatgcccagcagatttttgtactttctgtagagatggggtttcatcatgttgcccaggctggtctccagcttctgagctcaagtgattctcccgcctcagcctccagagtgctgggattacaggcgtgaaccaccatgcccggtctcatccttgtcttaatgacaaacatcgttttaaaaaattagatgttttaaataatttcttcaagttactattaaaaagcatcactgggacagttgatgtaatttgttcatgactacaggaccccggatgcatgctaataacattcattcttgttttggaaaattgtgctctagttacataagagcatgtcctggattggaagagaatacctccagtttttcttgggtaaaggcatgtagaggctgtatgttaactttttttttttttttttttttttttgagatggagtcttgctctgtcatccagggtgcagtgcagtggcaggacctcagctctctgcaacctctgcttcctgggttcaagagattctcctgtctcagcctcctgagtagctgggattacagggacctgccaccacatccagctaatttttgtatttttagtagagatggagtttcactgtgttgtccaggctggtctcaaactcctgacttcaggtgatccacccacgtcagcctcccaaggtgctgagattacaggtgtgagccaccatgccagccctttaactgtttaagtggttcagaaaaagatgatgtgtttgcatgtgtgtgtgtgtttgtgtgtgcatgtcaatggatacagacagagaatgatactgcaaacgtggcaacgtgttaacaatggtgagttgagtgaattcttagtatgatttgagtaatttttctataagtttgaaattattttagaacaaaacatgaaagtattttaccttttattataaaagtgtttagtctgctgggcacggtggctcatgcctgtaatgttagcactttcagaggccaaggtgggtggatcacctgaggtcaggagttcgagaccagcctggcctacatggtgaaaccctgtctccactaacaatacaaaaattagccgggcagcacacgcctgtaatcccagctacttgggagggtgaggcaggagaattgctagaatacaggaggcagaggttgcagtgcactgagatggcgccattacactccagcctggatggagtgacatagaaagattaatataataaaactcaataatctcatcacccagatttcatgcttactaatgctttgtcatgtcagcctttttattttttaattttttccttcagcctatttttttttttttctttttatagggtctgactctgttgcccaggctggagtgcagtgacacaatgacggctctttgcagcctccacctcctggccttgagcaatcctgccacctcagcctcccgagtagctgggactacaggtgcgagccatcatgactggctaatttttttatttttacttttcgtagagatagtctccctatgttgtccaggctggtcttgaactccagggctcacaaaatcctcccacctcggcctcccagagcgctaggattatagacatgagctaccgtgcctggcccatatcagccttttttaatttaaaattttaaaaagttggcggggcacggtggcttatgcctataattccaagacttcgggaggccaaggtgggagggttgcttgagcccgggggttcaagaccagcttgggcaacatagggagactcttgtctctacaaaaataaaaaataaaaaaaaaattagccagtcataatggcttacacccaaagtcccagctactcgggaggttgagatgggagaaccactctagaccgggagctggaggctgcagggagctgcgatcgcaccactgtactccatcctgggtgacacagcgagaccctctctccaagtaaataaatgaatgaacgaataataaaaaataaaaaagagctatcctgatacttcgctcctaaatcatctttttttccctaagtcttttgtatgcaccactaaaaaaaaaaaaagccatttttcctgcatgacccaacagaatgagctgtaattagcttgtaatatatgcaaatgtccatctgcattctgacttcccaagctgcatggctgccttcatttgcagcgggcagctgtgctgcagaggggagcagcatcagcaggcgtgtggagtgagtgagccccgtcctccccctcctcctgtcattgactctcattgcctaacccccttgtgtcttggccccaggttgattgtccggggctaccgccagcccctggagggcagtgacctctggtccttaaacaaggaggacacgtcggaacaagtcgtgcctgttttggtaaagaactggaagaaggaatgcgccaagactaggaagtaagtgtgagtttccttgtcctccaggatgccctggtcacctcctttccactcctgtggcctcaatccaggatggggccctggcagtgctgcctgttactagctttgtggttctgggcaagatgcctcacttctcctcctggcctcagtttgcttttctgccaaatggggtaggatctcacatgtcattaaagcaactgggcagagaaaagaagaaagaagctgggtgcggtggctctcgtgtctaatcccagcactttgggaggccaaggcaggcggatcacttggtcgggagtttgagaccagcctggccaacatggtgaaaccctgtctctactaaaaatacaaaaattagctaggcatggtggcaggcgcctgtaatcatagctactcaggaggctgacaggagaatcacttgaacccaggaggcggaggttgcagtgagctgagattgtgccactgcatactagcctgggagacagagtgagactccgtctcaaaaaaaaaaaaagaagaaaaatgttgtccaaacaggcagttgatgctgtctgccatggcgcgtgactatccctccttgagtcagtctcacttttttctgtctctttctgagcatctggcatcctgcatgttcttgctgtttgaatgttctgtccaacatgcccagctgaccacgtaagtctgtttagccaaagaagccccatttgagggtgattttggctgtactggattttaggctctaccccctatgtaaggcgtgccccactgcaccacctctgtcactcttcgggaatcaggccagtgcctcccctgcacataccttaactcatcaaatctgagacaccattagttgcgtgatgcgttattattctatgtaacagtaagaaagaaaagcagctgccaattaaacaaggacataagacttgtctcgagcccggacgaactggaacatgaaattgtgggtgacatgggggcagtggattgcggccatgggggtagtagaatggctgtttttgttcctgttgcctgttctggggtaagtttactacgataaactgtggtggggccagtgtggtgcattggattccccacagacccattggccttacagggaaaaaccccagaccggggttctgttcctcattctattccggggatgcccaggatacaggccttcagtcagacccagatggtgggtgggaatctggacatccatgtgccagccactaggacatcagcagaggacctcgtgactccggtcggaggctgtttgggtggtccaggtgatgggagaaattgtctcgtgggaggcagatagagcttgggcctctgtgactgagcattgtaaggaaatggcccatgtccatgacccagttgaaggtttttggcaggcaaaggtggggtccctgtttattacagttcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcctgagaacctggagtcattgggtaagtcccagaggccagaaatcctggagttctgatgttcaagggtgggagaggatgacatcctggctgcagaagagagagtgcctgcatttgccattactctgactttttgttgtgtccggaccctctgctgattgggcggtgccacccacatggggcgaggatggatcttccttagtcagtccactcattcaaatgccagtctcgtctggaaacatcctcacagacacacccagaaataacactttaacagcaatctgggtatcccttaacccagtcaacttgacccctaacatcacccatctcatctggattccttcagcctcacctgcagcatcccccccgctaagcaggccacatttgtagtgtgggcttcagcattcctcatcatccacgcctctgctgatcacctggctcggcttcctctcatggaagacggatgcccacctttgtgtcccctggagcttgtcaggagagcaggttgctggagacaccatgggagaggccaatatcacagccttgggaggaggacagagtttgaatccagaagctcctccactggcctggctcttaatccactgagcagatgaaactgactgctgcttttgtgcttagcgacgtttagtccctgagggttcagagagtggaacaaaagagacacactctagttgggtgccatcgacattctatatgggagacaggacgttggttgtgaaacatgcattgacaagaagctttggagaatgatggtgttggggtgagataaaaatgaggaaatgagggtgagagtaaccgaggaagcttttgtgtgtgtgtgtgtgtgtgtgtgtatgtatgtgtgtgtgtgtgtgtgtgtgttttctttttttttttttttttttgagatggagtctcattctgttacccagggtggaatacagtagtgtgatctcggctcactgcaacctctgcctctcgggttcaagcaattcttctgccccggtctcccaaagtgctgggattacaggtgcatgccaccacgcctgactaattttttgtatttttagtagagacggggtttcaccatgttggccaggctggtcttaaacttctaatctcaagtgatcctcctgccttggcctcccaaagtgctgggattacaggcatgagctactgtgtccggctgagagaggtgttttagatacagtggtcaaaggttctacccagtgtggccatgacccttggtgagcatgtgcctgtccctccctaagtctatctctggctgttttcgagcctctggcatcctgagtgttactgctttttgaagtgtttttgttcaacatgcccagctgaccatgtatgattgttttgagaaggtcacatttgagcagagacttgcattggagggagtgagccttgtgtgtatctggggaaggaagggctttccaggtagagggagcagccagtgcaaaggctctgaggacactcgtggtgcatcagggggcttgtgtggcttgaggaaagtgagtgagggggagaaagggaggagatgaagcaggagaaggatttgcaggggtctcctctgagagttaaggtgggattccaggtgcagtgagaacacaggcgcaggttttctgcagggcagtggtgtgacgtgagttctgttgtttgtttgtttgtttgtatgtatgtatgtatgtatgtatgtatgtatgtatgtatgtattttagagacagggtcttgctctgttgctcaggctggatggcagtggcatgataacagctcattgcagcctggaaattccgggctcaagcagtcctcccacctcatcctcccagagtagctgggattacaggtgcacaccaccatgcctggctgatgaattaattaattaattttatattttatatttgtttttttgagatggaattttgctcttgttgcttaggctggagtgcagtggtgctgtcttggctcactgcaacctccaccccccgggttcaagcgattttcctgcctcagcctccggagtagctgggattacaggaatgtaccaccatgcccggctaattgtgtatttttagtagagatggggtttctccatgttggtcagtctagtgtcaaactcctgacatcaggtgatctgcctgcctcggcctcccaaagtgctgggattacaggtgtgagccactgcgcctggcctttttaaatttattttattttattattattatactttaagttttagggtacatgtgcacaatgtgcaggttagttacatatgtatagagacaggtctcactgtgttgcccaggctggtctccaagtcttggcttcaagcagtcctcctgcctcagcctcccaaatagctgggattacaggtgtgagccaccacacccagctgagttctggttcataacaacccaggctgtcctggggaaggtggatatttagggacaagagtgaaggcagggagaccagggtgggaacctcaagggctgtccatgaagtcccttcatgcctcaccgggagccgccattgtatttatttatttattttttgagacagggtgtcactcttttgtccaggctggagtgcagtggcacgatctcggctcactgcaacctccatctcctaggctggagtgatcctcccacctcagcttccctagtagctgggactacaggcacgtgccaccacacctggctaattttttttttttttttttgtagagatgatatctcgccatgttgcccaggctgttctcaagctcctgagctcaagcagtccacctaccttggtctcccaaagtgctggtattacaggcgtgagccactgtgcctgactggagcctccatttttcacccagagcattttctgagaattcagtgagatatatgatatgataagctgtgccctagccctgagtacatgctgggcaggttttaattgtacaagttttatttattcatctgtacactttgatcttgccagggaggatgtggtgagaactgggtcttggggcttgaaagcgggccacctgagaagggtctggctctgtgagtaccttggtgtttagagatcctcagcgtggagccaggggatcatttacttgggacattggtagacggatcgcttgctttattcccagaggcataagccagatctggcacctgtaacccctgtgaacctggagagagtgagaaggaaaaccctgtcctaggctggaatttcctggtgtggccccttacactcagatcccttttgttaaccagagaaaggaatgcagctcgtgcagctctgggctgctgggtatcctaggctcggggatcaggtgatggacgccagggctgggggctctgcatggcttcctggatccttttaccacctctcttcacccatgagtgactccttctcaaaagtcaggtgtggctgggcatggtggctcatgcctgtaattgcagtacgttgggaggctgaggcgggaggctcacctgagttcatgagttcgagaccagcctggccaacatggtgaatccctgtctctgctaaaaatacaaaaattagccgggtgtggtggcgctcacctgtaatccagctacaggggggctgaagcatgagaattgcttgaattgtttggatttaaaaacccagtgcttcattggtttgtgtgtagtggttttatgttctcttttgtgtatggccactcagagcttagggccattttggactgtggtttctgctggcatgaatgtgaaatgcttctgtgactctggaagagtttggcagttttttttttttttttttttaagttagacacagtgaacataccaccagtcacccccttcccaggcatccagccaacagagctgagaacatatgttcataaaaggctggtacaggaatgttcttagctactttgtgataacccaaactggaggtaagccagacatctattagcaagtgaacagacagatgcaccagttatgtacatctgcacaactgaatactaagtgatgtacaagaacgaactattggccgggcacagtggctcatgcccataatctcagcactttgggggcccaaggcaggcagatcacttgaggtcaggagttcaagaccagcttggctaacatggtgaaaccctgtctctactaaaaacataaaaattagctgggtgtggtagcgcacacctgtaatcccagctactcgggaggctgaggcaggagaatcgcttgaacgcaggaggcggaggttgcagggagtcaggatcgcaccattgcactccagcctgtgtgatagagcaagactccatctcaaaaaaaaaaaaaaaaatccctataagataaagactacttttttggtgacagctttattgagatattcatacaccgcacaattcatgtatgcagaacatacaattcactgatttttagtgtgttcacagagttgtgcagtcatcatcacagtcaattttatttatttgctttttaagacagagtcttgctgtggcgctgaggctggagtgcagtggcacaacctcggctcattgcaaccccctcctcctcctgagttcaagcgattctcctttctcaccctcccaagtagctgggattacaggcaaccgccaccatgcctggctaattttttatatttttagtagagacaaggttttgccatgttggtcagggtgttctcaaactcctgacctcaagtgatccacccgcctcgacctcccgaagtgctggcattacaggcatgaaccactgcacccagtcaaaaaaaaaatttttttttagaaatagggtcttgctgtgttgctctggctggctggactgtttttttttttttttttttttccactgatgtatatatgcctatccctttacctgtcttgatgattgttgttcttttttttgttttgtttttttctttttgagactgagtctttttgcccaggctggagtgcaatggtgtggtctcagctcaccacaacctccgcctcctgggtttaagcgattctcctgcctcagcctcccaagtagctgggattataggtatgtgccaccatgccgggctgattttgtatttttagtagagatgaggtttctccatgtttggtcaggctggtcttgaacctgccgacctcaggtgatctgcccacctcggcctcccatagtgctgggattacaggcgtgagccactgcgcccagcctattgttgttctttctttttgagatggagttttgctctgtcacccaggctggagtgcaatggcctgatctccactcacagcaacctccacctcccaggttcaagtaattctcctgcctcagcctcccaagtagctgggattacaggcacctgccatcatgcccggctaatttttgtatttttagtagagatggggtttcactatgttggtcaggctggtctcaaactcctgaccccaagtgatccagccaccttggcctcccaaagtgctgggattacaggtgtgaaccaccactcctggccatgattgttattttgtattgttttgaaatcaggaagtgtgaatcctccaacttgattcttatttttcatgattgttttgactgttctggatccttgagtttccatgtgaattttaaagttagctcataatttctacctggcagccagctgggcttttgatggggattgccttgactctagatcagtttggagccatcagttttctaagtctttaacttattcaactcgtttaatcttacctaccttggaggtaggtcctacttttatcctcatttcacagaggaggaaactgaggcccagagagcttaaggaccttgtctgaagtcacgcagctggccagtggccaagccagaccttgagccggtggctctggagcccgtggctctggagcccgtgtttgtaaccactgtgctgagctgcctctttccctgggcttgttgtctttgactctgccttccctgaagggtgacattccctggccatgtccctgtggtagggggctgcatctctggcagaccccacaacggcttcacctccttgtgttccaggcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagtaagaccccttccctcccaggtgggctccattttccctccttggctttgatctttcagttgcatcagtcataaccctggggtcatgctgtgtcctgaagtgggctcatagccagatgtctccatttttactttagcttttttgaaaaaaatagagacagggtcttgctttgttggtcaggctggtctcgagctcctgacttcaagcgatcctcctgcctcggcctcccaaagtgctgggattgcagatgtgagccatggtcactgcctagctttactttatgctttacttaattaccatattagtgaagaccacatcgtttgcaagtaacagaaacccactaggctcccctaaaacccaaatggggaggatatggcattgtcttgggaaaccaagagcaaggaaatgccagcagatctcatgaaaaaactgcaaccagggttgggcgcagtggctcatgcctataatcccagcactttgagaggctgaggtgggaagatcacctgaggtcaggaggtcaagaccagcctggccagcatggtaaaaccatctgctaaaaatacaaaaattagccgggcgtggtggtgcacgcctgtaatcccagctactcaggaggctgaggcataaaaattgcttgaacccaggaggcagaggttacagcaagctgattgcatcactgaactcaaaccttggcgacagagcaagactttgtctcaaaaaaaaaaaaaaaaaaaaaaagaataaaaacaacaacaaaaaactgcaaccaggaactggggagtcagaaaggaagttgcctctctcctacctggctctctgctgctctgtgactcaggggctacacatcccttctcttttcctccctacctctttacctcgtgttccctatgcaattcctttgggtgacttgctggtgatgagatatagctagagcaattagtgcacaaccccaaggcagaggcctcttttatgagcagtttgggtcacctgcacagccagatcaccactgtggacttgtttttccatctatgaaattgaagtgatagtgtctagctcatctggctcaggagaaagttgcagtgccaacactgaagctctcttccctgcccccacgtgtcacaagtcattccaggccctctctttgctcctttgcaggttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggtaggggacgctgtgccattggcatgtggcccgacttccacatcccctcctgcagccctgggttactctggggccagcgtggggatttccagcccagcttctggagcagtaggatgagggtagcttccgtgaccttaggtggcagggacagcacgcatcaggcattgtacgttaggaaagctgatttcaagggtgggcgtgtagatgtctttgtgtatcagctgtgagtaattgagtttcttagatggatcagtggcccttgttgtggggaaatccaagtttggatcctcattctgctgttaacattctgtgtttcagcttgttgtcactctttttttttcgtttttttgagaccaggtctcactctctcccccagactggagtgcagtggcatgatattggctcactgcaacttctgcctcctgagttcaagcgattcttctgcctcagcctcctgagtagcggggactacaggcgcctgccaccacgaccggctaatttttgtatttttagtagagacagggtttcgccatgttggccaggctgatcttgaactgctgacctcaggtgatccgcctgcctcagcctcccaaagtgctgggattacaggcatgagccaccgcgcccagcctgttgtcactcttaatttgaactgagcaggtggcacattccttgcatggtaagagtatgtagcaggcatttgtgtacatccaatttcaaaggacctaaattaccttcttgatccctataaatttttttttttttttgtctcgaggtcaaggaaactgcttggctcctaggttaggaagagacagtcttgcaggtacttgatgaactagaggagtgattctcaggcctgtctgtgaattagactcacctggggagcttaaactgatgcaggccaggcactgtagctcatgcctgtaatcccagcagcttgggagaccaaggtgggggaatcactggaggcttggaagttcaataccagcctggtcaatatagcaagaccctggctctgcagaaaatttaaaaaaattagccaggtatggtggtgcgtacctgtagtcccgtctactcaggagattgagttaaaagaatcacttcagccccggagttggaggctgcagtgagtcctgatagcatccctgcattccggcctgtgtgacagaatgagaccctgtctgaaaaaacaaaaaaacttcctgacacctaggttgcaccagaccagtgaaattgcgattgctgtggtggcacccaggtgtcattgtttttgttttttatttatttttatgttttgagacagggtctcgctctgtcacccaggctagagtgcagtggcatgatcttggctcactgcagcctccacctcctgggctcaaacgatcctgccacctcagcccaccacgtagctgggcccagaggcatgcatcaccacgcctgctaatgtcttagtgtttttaaaactcacgaggtgatagtgtgcaatcatgtttgagggctagggacattttcccccaccagggcacgtttggcaatatctgggggcattttcggttgtcccaactgggggcgagggcatgtagtgggtcgaggccaggtattgctgctaaaactcctacagtgcgcaggacagccccccaaagaattatctggctccagatgtcaagaatgccaaggattagagaccctggcccacaccctcagtccttcagtgggatctgggaccagtagcactgacacagcctggaagcgtagaaatgcagaatcccaggccacaccccagacttgcagaatccaaaacaactccccccaccccccaccactccccccagaaaaacccggccgcatgtgtgcacattaaagcatgcgaagccctggtttcgaggacacctagggtcccttgccaactgatgagttcaaggttgggaggcactgagcaccgcggataagaatgtgggctttgagatgacacaggcgtcctgggcagacagataggtcgggaggggaggaggagagatctgcggcatttctgcccctgagagtctccttcctctccgtgggtctggagggagagtcaggcctcttcagctgccacactcacccaccttccctctcctttgtcccacaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctggtgtgtgtttaacgccgtttccctttgcatgcagggagggacttctacgtgtgggcagtgggccgagggagtgggtgttgatggtaatggcatgtagagctccctggcagttccggctgtggttcatattttattttccagcctgttaaccaattcctcagtattttgttcctttcctgaattgtcaggttgatgttctccttggtggcatggcgttttcattttctcttttccttgacagtgtcagtaattaactaccctacaatggacgacacatcatatttctccccttgaatcctcccaaacgctaaccagactcacttattcattagtccctaattatggtggtcaaaattctctcaattgcaagggatataaatctgtcttaaagtagcctaagtggccggttgcagaggctcacgcctgtaatcccagcactttgggaggccgaggcgggcagatcacctgagatcaggagttcgagaccagcctcaacgtggagaaaccccgtctctactaaaaatacaaaatgagctgggcgtggtggtgtatgcctgtaatgccagctacctgggaggctgagacaggagaattgcttgaacctggaaggcggaggttgcggtgagccgagattgggccattgcactccagcctgggcaacaagagtgaaactccaattccaaaaaaaaaaaaaagtagcctaagtaaatagagggaactttggggctgcatgtatctcagaaatctggggactagcttcaggtgtggattgatccaggagatcaagcaatgttgtcagtactcagtttcacccactgccctgttgtcctctgagttaacatcattctcagtggtacttccctacatggctccgtagctttgggctgataacatcctgatagataaaggtgccagagaaaagacaaggcagcatttctctgcacagccagagtcagtctcagagagcactctgattagcctggcttggtcctattcacacccgtgaaccaatcactgtggcccaggaggcagagttctctcattggccagcctgggtcacatgtcctctcccatggcagaagagatgtgattgacagcccttccatgtggagagggagagttcccaaaataaaatgataagcaaagaggctcatagcacaacacatgccttgtgctttgctacctctggatctttgccacgtacctttccttccttcttcctaattgatgaaagcctgctcatcccccaaggctgtaacaaacactacttccattgatttaccctcccttctcaattagatggacttcttcttttgaattttgagtcccaataactttagtataggaactcatctaataatactttctgaaatagttttttttgttttgtttttgttttgacatggagtcgcgctctgttgcccaggctggagtgtggtgtgccatcttggctcgctgcaacctctgcctcccagcttcaagcaattctcctacctcagtctcccgagtagctgggactacaggcttacaccaccacgcccattaaattttcttttttttttgtatttttagtagagacagtgtttgatcatgttggctaggctgatcttgaactcctggcctcaggtgatctaccctctgtggtctcccaaagtgttggaattacaggcgtgagccaccgtgcccagcccactccctgaaatagttttgttttgttttttttgcatgctcagtgtactgcctcctctttgaagggtaacatgttagctacttgcagacatatagcagctgacttttgtgtcttctgtgggtacaaccccagcagggcctgatgcataatgggcacagctcaaattattatctgttattgaaagagaagggctggacgaaatggctcatgcttgtgatctgaacactttgggaggccaaggcgggtggatcatctgaggccaggagagcagcctggccaacatggcaaaaccccgtctctactaaaaatataaacattagtcaggcatggtggtgtatgcctataatctcaactacttgggtggctgaggcaggagaatggcctgaatccgggaggcggaggttgtattgagctgagtttgtaccactgcataccagcttgggcaacagagcgagactctgtctcaaaaaaaagaaaaaggaagaagaaaaaattactggtttatttggctgtagtttggtttttttttgtacatttgtagagcagaaggtgagtaaagtgtttctaataataaaactcagaaaaaacaccagaatttaattgtctaataggctgggtacagatataggtggcatgcgcctgtaatccctgcactttgggaggctgaggtggaaggattgcttgaagccaggagtttgagaccagcctgggcaacatagtgagaccctgtctctacaaaaaaaaaaaaaaaaaaaaaaaattagctgggcatggtggtgcctacctgtggtcccagctaccgtggaggctgaggcaggaggattgcttgagcctaggagtgcagaggctgcagtaagctaggatcacaccactgcactcctacctgggtgacaaggcaagaccctgtctctagaagaaaaaaaaaatctaaataaagtgtcttttcaagcaggtgtcttggggagtccacttttgtaaaagtgctactatgggaaaaatatttttggaacatttgttctagaactgccttcaggattggtttatgaaccgttaagaaaattgtctaacatcacgttttgttttagatggtagttgcttgagctcagcactgttgacacttggggccagacagttctttgttgtgggggctgtcttttttttttgttcttgttattgttttttttgtttttttaagggacagagtcttgctctgttgcccaggctggagtgcagtggtgcgatcatagctcactgcagccttgaattcttggcctcaagcagtcttcccactttgtcatctcatctagctggggactacaggtgcacgccaccatgcctggctaagttatttatttttttgtagaaatgggggtcttgctgtgttgcccaggctggtctcgaacttctaccctcaagctatcttaccactttggcctcccaaagtgatgggattacaggtgtcagtcactgcacctggccacaaggctataagttaatacagcaaaattagcaaggaattaaggcacacatggggcggtgttcaagagaagccaggtgcaggcttccaggagtccccagcagagtcacaggttcactaattctctggcaaccatgatgattatgtgtgtgaaatgttgccaaccagggaagcttggtaggagctcagttcctgggtttgtattaggggcaggtcacataagcagcctttgcttggcacataccaaaagtctagactcccagagggaaagcggtgttcagcataaaccatattgtttgtacaaacagttgaggcacactgagctactctacccaattctgttaatggtggaaaccctgtaagtatgcagacactagccaagggctaaacttgtaagcagccttcaagcaggaaaagcaatcaggtggtcgtgttcacacttttctgcttactaccttattacctttctaaaaatctaagctgggtgtgatggctcgcgcctgtaatcccagctacttgggaggcagaggtgggaaagtcgcttgagcccatgagtttgagaccagcttaggcaacatagtgagaccttgtctctacaaaaaatcaaaaaaatagctgggcatggtggtgtgagtgtagtcacagctacttgggaggctgagttgggaggatcacttgagcccaggagatcgagagcagtttgagtaacatagtgagaccttgtccttacaaaaaaccaaaaaaattagctgggcatggtgatgtgactagtcacagctacttgggaggctgaattgggaggatcgctggagcccaggagttggagaccagcctgggcaatgtagcaagacctaatgcttacctgtagtcccagctactttggaggctgaagtaggaggatcactgatgcaaatagccactgtactgcagcctgggcaacatagcgagacctcatctcctaaaaaaaaaaaaattagaatcctgcagttgtaatttgcaaaactcatgtggccccaagggcttgggagaaaggagcgtggacctgcttattcttcaagggattgggaggacctggagagatgctcaggaatgaaaccacaggctcttaacaccctattgtggggtaaaagtaacacaccttgccctgaacttggtcagcagcatccacgtgggatggatcaaccggggaagctgttacgggccctgttttcttctgtctggtgagtgatgaagagtctcctttccttccttagaatctgggcccttccgtcctggctggagtggcggtgatggtcctcatggtgcccgtcaatgctgtgatggcgatgaagaccaagacgtatcaggtaaggcatgtgtctctgcgggcccccaagccgggccctaggcagaggcctctccatgaggattttagtccagttccttctgctctgtccctggggttctcagccttgcctgccagttggactcacttggggagccttaacaaatgctgatgccccggctgcatatctgggattctgattcacttattgtgggtggggtctggacatcaagatgttttaaagcttcccaggtcattatattgggcagccaagattgagagctcctgacacatggttagaccttgtaggccggtgactggaatcagaaggtctgtgagcctctgagaaagtccttgtttcccacggtcttgtttattatgtgtatgtgtgactcagctttcaagagttgagtacaaattaccccctacttttttcccccttattagctcttaccttataggatacatgctgttaatctctttatttaaattaaaataattaatttctaaaatggggccttgctgtgttgcccaggctggtctcaaactcctgggcttaagtgatcctgttgcctcagcctctcaaagtgttgggattacaggtgtgagccatcatgcccggctttcagctttttatttttggagatattttgtattttaaaaagtttgaatacccaagtaatagagtgatgtttcttattataaaaaagtccaaatcaagccgggctcacccctgtaatttcagcattttgggaggccaaggtgggtggatcgcctgagcttaggagttcaagaccagcctgggaaacatggtgaaacctgtctctaccaaaaatggaaaagttagctgcatgtggtgatgcgtgcctgtagtcccagctacttgggaggctgaagcatgaggatcacctgaacccaggaggtcgaagctgtagtgagccatgattgtgccactgcacaacagagtgagaccctgtctcaaaaaaaaaaaaaaaaaaaaaaaaaaaaaaaaaaaaaaaagtttaaatcgtacaaaagtacataaattaaaaggggatacccccttccctactctctcaaccactgcaaatatatagaagcaaatccttctacaactttctacgtatgtatatacagacctgattaatggtatagtttggtttgtttttatatatgtgggtttttttttttgtttgtggagatggagtctcactttgttgcccaggctagagtgcagtcgtacgatcttggctcactgcaacctctgcctcccgggttcaagtagttctcctgcctcagcctcccgagcagctgggattacaggtgcccaccaccacacccagctaatctttgtatttttagtagagatgaggctttaccacattggccaggctggtcttgaactcctgacctcagatgatccacccgcctcggcctcccaaattgctgggattacaggcatgagccaccatgcctggccattatatatgttttgtgtgtgtgatattattaccatatctgtttttacctaaatgggcccacgtggcagcatgatttttgtcctttagcgccctgctttggggacctctctgtgctgtgccgtatagcttcaattcattcttccaacccggtgccttttggtctataatggagatggtgcagtttatttctttgctcttctgttgatggatatttatggtgtgctgtggaatttcaaatgggagcactaggctgcactgacgataccacagggagatgagtttcaggacatgggcctgttggaaggagaggcctcacgtggtagggttgggtgggatgggtgaggcaggggctttaggattgagtcacccttcagtctcttgatgtgtaggatgccctgagtggcccgactcaacccatttcagtccctggcctccagatcatgtagcttatattcttcccatctgtgacccggggatgactgtagcactaaatgataagagttcttgtgattgttaagtgtctgaatacatgtaaaatgcttagaaaagttgctgggatacacaaaatcctgggtggtagtaaaagtatttaacaactgcactgcacaagtatccactatttggaaccagtgctagccagtacagaaacatttcactattttaacaaccatgggccaggcacaggggctcatgtctgtaatcccagctctttgggagcctgaggcaggaggttggcttgtggccaggagtgcaagaccagcctgagcaacatagcaaggtgccatctctacaagaaatacaaaaatgaactgggtgtggtggcatatgcctgtggtcccagatactaaggaggctgaggtgggaggatcgcttgagcccaggaattcaaggctgcagtgagctatgatcatgccactgcactccagcctggatgccagagtgagatgatgtttccaaaaaaaaagaaaactgggctgacaagaaataagaaaacaggctgggtgcggtggctcacacctgtaatcccagcactctggtaggccgaggttggatcacttgaagtcaggagttcgaaaccagcctggccaacatggtgaagccccgtctctactaaaaatagaaaaattagccaggcgtggtggcaggcgtttatagtcccagctactcaggaggctgaggtaggagaatctctttaacccgggaggcagaggttgcagtgagccaagatcgtgctactgcactccagcctgggcaagagagcgagactccgtcacaaaaaaaaaaagaaaaaatacgaaaacagagaagaaaaacaccaccaccatgtctcctgtgtttgggtcagcagagtagggactgaatcccttcttttctgtacacctgaagggtttttcttgcctctgttcctggattctaaattgagtatgtttctccaatgtctaacctaacgtgatttgaaggggttttttttttcttgatagcggggtcctttggtgtggtcttggggctcaagagtagggctagtagggattacagggtcagctctcccaccctcaggaggcccatttttaatagacggtgaagttgaggcccagtgcggtggctcacacctgtaatcccagcacaggagtttgagaccagcctgggcagcatggtgaaaccccatctctattgaaaagaaaaaaaaaaatcaatataaaaaacatttacatgtcaaagtatataataaagtttatgagaaaaatagctggtgatgttgagtgatgggctgatcccagggtcgccccagatgtgttgactgcccgtctcttccaaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtgagtgaagccacatttttcctggccctcattgtttgatgttttattttctctgcgtacctgaatatttttaaaaggtcactatgttgcccaggtgcagtggctcatgcttggtaatcccagcactctgggaggccaaagcaggtggatcacctgaggtcaggagttcaagaccagcctggccaacatggtgaaacccagtctctactaaaaatacaaaaaaataagccgggtgtggtggcgcatgcctgtagtcccagctactagggaggctgaggcaagagaattacttcaacctgggaggcgacggttggagtgggccaagatcacgccagtgcactccagcctgggcgacagagcaagaccttgtctcaaaaacaaacaaaaaagtcactatgtcagcaaggccttccctgaacacttggtttaaacatttgccatcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgccatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttgggagtccaaggtgggtagatcacttgaggccaggagctcgagaccagcctggccaacctggtgaaaccctgttactgcttaaaaaaaaaaaaaaaaaagaaagaaaaaaaaagctgggcatggtggtgcatgcctatattcccagctactcaggaggccgagacatgagaatcccttgaacctgggaggctgaggttgcagtgagccgagatcgagccacggcactccagcctgggcaacacagcaagaccctgtctcaaaaaagtaaaaaaaaaaaaaaataagtaaaataaaatgtacttattttattgtctgcttttcccccactaggatgtcagctccagatgggcatttttgtcgtttctcttgactgctgtatcctcagtatataaaacagtgcatagcaggtgctgaacaaatattgtcatccattgtaaaaaaaaaaaaatacagaaagatataaaatgaaaagtatattgtcctctcttccatcagttcctcccttctaaagtgacagtttcgtgtacgcttttagagaaaaatggacaagcatataggtatttaaaaatactttgacagatataaatggaatcatactgtacatagtgttctcttttctttggttaacaatatatagtcttggttcgttcattctggtctacttcattttagttttttggggggttttgttttgaaatggggtctcgctctgtcccccaggctggagtactgtggtgcgatcatagctcactgcagccttgaactcctgggcccaagcaatcctcctgctttagtttcctaagtagctgggactccaggtgcactgctaccactcccagcttgtttcatttgtgttcatgatggatgcttgtctgacgtgcagatgcgccctgctggaattaccctttctcccattccttgcaaaaacaggttgttccctgttttttttgctgttatgatccatgctacactgaaagttctggtacctgtcctggggtatggtaatgggtctatccctgcctagctggctttgaaaagtttaaagacaacagtgcaacttacaatttgcaaagttggccgcaaatcaggagaccatacagagatggactttggaaattccctttttaagcacagttaaaaacagttaatggtgaaggatgacttcagatcatgccccatgtttgttttttctttctgtctttttattaactgtgtcattctttttgtaatgttgtgctcattacaactattccttcttggtcaggttggcaaattatatgtttttctggcaagtttctgtgaagcagagttaaacatgtttatgaatatgaacttttctgttaaactaccatctgcttcatctttgttgagtttcaggtggaatgtctaaggaagctccagctgtttcagcatttgcgaaagcgtgttcatgctcccactgaattttcttagtcttgccttacttctctcagggtctggaactgcaggagagatggtgttcaaattcaagcctgcatcagaatcacctggagagcttgttattatattttattatttattcatttattgagatgaagtcccagtctgtcacccaggttggattgctatggcactatcttggctcactgcaatctctgcctcccgggttcaagcgattcttccacctcagcctctgagtagctgggattacaggcatgcagcaaccatgctcagctaatttttaaaatatctttagtgtagagatggtgtttcaccatgttggccaggctggtctcgaactcctgacctcaggagatctacccgccttggcctccgaaagtgctgggattacaggcatgagccacagtgctggctgttagcttgttactataaaactcagctttctgggccccacccaaattttcagttttagtaggtctggttggggcctgagtatttgctttcctaacatatccctaggtgctgctgcttctggttcaggttgacatgtagagacaccggagtggatcctcactgcctaaagtctggtccgtggaccagcagccatggcatcacctggtgcttgttaacggtgcagaatttcaggcctcagcccagatccactgaaacggaatctgagttgtaactagttctctaggtggtgtgtatgcacattaaatttcgagagagactggcagaaagtaggagtaaagaaactttttctgtaaatactttcggaattccgggccatacagtctctgtcacaaataccagtctcttccagcgtagtgcaaaaacagccttagataatatggaaatcgatgggtgtggctgtgttcctgtaaaaaagtatttagagacaccaaaatttgaattttatagaatttgcatgtgtcatgtaatattgttttgatttttttaacttttaaaaaatatgaaatctggctgggcgcaggggctcatgcctgtaatctcagcactttgggaggccgaggcgggcgggttgcttgaggctagcagattgagaccagcctagccaacgtggtgaaaccccgtctatactaaaaatacaaaaattagctggaagtggtggtgcgcacctgtggtcatagctactcgggaggctgaggcaggaggatcgcttcaacccaggaggcagaagttgcagtgagccaagatcatgccacacactcctggctgggcaacagagtgagaccctttcctgctgctgcccccccaccccctcccagccccccacaaaaaaaaattagccaggtgtggtggagcatgctggtcatccaagctttttgggaggctgaggtacgggaatcgtttgaacccgggaggcggagatcgcagcgagctgaggtcacgccactgcactctaagcctgggcaacagaacaagactctgtctcaaaaaaaataaaaaaaatgaaatcaatgctgagctcatgggccgtatgtaaacaggtgtgggccaaatgtggacctgagccatccttgttggccagcccctggcttagaggactggaatgttcttctgagaatcaggacacctgccacattctactgccagctcacagtgtgaccccaaagctggtcatctcacctcgctggctctagattttgtcacatggaaaatgaaggggttagattccaagcatgtcaaatactgggccctgtcctccttcctcatgcccacagcagacacccacagtcactcatggggttctttcccactgagttatgttcaagcagccctccaggtgactggtgccagtggcctagagttgagcaagaaatgacatcttgttgcccttctgtaactccatgttccctaagatcacttccagctccaatgcccctgcattctgccttgtacattgcattcttcttacactccaataccttgactttaccggggtgcgttgatgaactctctctttttttgttttttttgggactgagtctcactctgtcacccaggctgaagtgcagtggtgccatctcagctcactgcaacctccatctcccagttcaagcaattctcctgcctcagtcccccgactagctgggattacaaacatgcactaccatgccttgttaattttaatatttttagtagagatgggtttttgtcatgttcgccaggctggtctcgaactcctgacctcaagtgatctacctgccttgatctcccaacgtgctgggattacaagcgtgagccaccgcgcctggactctcctttttttttgagaaggagtcttgctctctcgccaggctggagtgcattggcacgatctcagctcactgcaatctctgcctcttgggttcaagcgattctcctgcctcagcctcctgagtagctgggattacaggcgcctactaccatgcccagctaagttttgtatttttagtagagacggggtttcaccagggttcaagcaattctcctgcctcagcgtccgagtagctgggagtacaggcgcacgccaccatgccaagccaattttttgtatttttagtagagatggggtttagccgtgttggccaggctggtctcaaactcctggcctctagtggtccacccacctcggcctcctaaagtgctgggattacaggtgtgagccgccatgcccggtgggtcttactttataaagtaggaagtaatgtatttgcatatggtgaaacataattaaagctgcaccagatggtattcatacagccggacttcgcacgtggccacctcagcctgctgacattcgccaacaggtcatcctttgtccctgtgttgtagggcctggactgcacattgcaggatgtttcccagcatctgtggcctctacctgccagatgctaagtcgtacctctccctcttcttcccagtggtgacaatagaaaatggctccaggcattgcgaagtgtccccttgggggacagaattctcccagttgagaaccacagtcaatagtgaaaggcccaagcccttcctcctaacaccagtcaccttgcttccctctctccatgtttcttgtgtgtttttccagagtccacgtctgtatcactgtaatggtggatacatgtcatacatgtagttatggttacttgattctgtttactttacttttatacaagtgatagtaagagtcatacataaatacatacaaaatggctttttttttctttttttctttttttttttttttttttgagatggggtctcacactgccgcccaagctggagtgcagtgacatgatcttggctcactgcaacctctgcctcccaggctcaagtaatcctccaacctcagcctcccaggcagctgggactacaagcatgcaccaccatgcccagctaatttctgtaattttgcagagacagggtctcactttgttgcccaggatgttttcaaactcctgagctcgagcagtccgcctgcctctgtctcccaaagtgctgggattgtaggtatgagccactgcacctggccttgatggcattttgaaaggtcttgtctcagaggaaaagatacaagccagagggcgctggtgatgaggtttggtctgtgccttgtgtcccgcttaggaggggatgggcagcgtgttctcacagctttttgctctgcacattggattcgttggcaaaacccacagtttccaggctgtcaccaaactttgcttatcacttcctgccctgttccccattaggaaaccacagcagaagatgcttaagagcaggactggcttttcttctcttttttctttctttctttcttttttaaagagacagggtcttgttttgctgtccaggctggagtacagtggcttgatcacagctcactgcaacctccaactcctgagctaaagcgatcctcctgcttcagcctctggagtagctgggattacagatgtgaaatactgagcccggctaccggctttacttaaccttttcttgagctttcttgccatttagtttcccggagtttccagagacagagtttgttgagctgtttggcaagaaacagatgggcctgggtgtcagctggggagaccttgtcctggccgaggcatcgaagcctctgactacattaggataaaatatgtggcctttagttcccctggaaggtgcctgagtgttttttccactggtgtgcattcctgtgcttcaaagacgatgaggtgtttacccagcggtaggtgtgatggaacacagaggccggggaaggccagggatgccatccagggactgatgggactgtttttctggaatggcaaacctggcatttaccacgtccacctaatgcactttcctaaaatagcatcgccaggcagccgtcaatatttaacattttctgtcttggatgatttgtgagcttcttgccttctgtttaccctgaatctccctttgttagaataattcatcattctctatggtaatgatctgtcctgtagttctctgctgatcatatcctagggcccatggagacactgccacgaccatgtcattttatttatttatatatttatacatttctgtatttttgagacggagtctcattctgccgcccaggctggagtgcagtggcacaatcacagctcactgcaacctccacctcccaggttcagctgattctcctgcctcagcctcccgaagagctgggattacaggtgtgcgccaccacacctggctaattttttgtctttttagtagagatggggtttcaccatgttggccaggctggtctcaaactcctgacctcaagtgatccgcccacctcggcctcccaaagtgctgggattgcaggtgtgagctaccatgcccagtcagaccttgtcattttgtgcttgtaccagcaaagcatagggaccttggcaaatagttcatgctctgtaaatgtatgtaggtaaatgaataaatacatgaatgaatgagaggttgaaataaatcatattaattaggaactgtcttgcaaataacagaaacctagcttaaatcaactagagtaagagaagagggggatttttgagtcacaaaactaaaaagtctagaaaaagacttttaagcatgaatggggttccaggcatggctggatctaggagttcccaagataatgttgggaataacaacgtctctgactctcagctctgctttcttgatggtggtttctttattagctggtagtttcctgatcatcctgtcacctcagcaacccctgtgaacagagagtcttactcttttcccctaatatttcctgcaaagctatgggattgagtctcattggttgtggtcgatcacatgcttcttcctgagccagtcactgaggccagggagataggatgcttgggtcagccagggctaggtcatgtctttcagggcttggggccaaggtagggggtgagggaggaggttcatctgtggctgaagctcataggttgacactgggagaagttcagttcccccagagaaaattgcatgttgccataaacagagtaatagatgccaggtaggcaggaagagcaggtaactgcacacagggcatcaggatttttagggagtgggctggagtgtaggggttccattcattggttttccacgtttctcagaaaaggcacctaggggacaggtgctcctcactgtgtatgaagggcttttgcaccctagaccctcgcctattacaaggcgaactccagtctcctgctgcctggagccccagtcattgtgcccgtcctaccagcctcttcggatttccaaacactgcctgcagggaacctgttaaagcctgtgcttccactagactgtgcgtctcagggttgccaagcccacctcagtccccagcgcatgatgggtgctcagttaccacctgaggggtggatggctagatgacctcctccttctggagaagccaggaccatggacctgaaaggggccgcatgatgttgtcctgtcccctctctgtgtgtgccctgtgctgccagcagccggcatcgattggtacttggctcaccaagggggctggtacgttttggtggtgagatgcctgaggcctggtttgcttcactgctgaagagacacctgtgatgtgctcttctgccctcaggcaaattcacctaccccgtccccacccatttatccactcccacccatccattatctatccagcagacattcactgagcaccatgatctgggctctgtcctaggctctgacaatacagcagtgcatactacaggtaataatctccagtcatggaacattcatttttcacggagagaaacagacaaggaaaaataggcacaataaataaatcctagtgctagagaaagccatcctaagtgctatagaaagaaaagagtcagatctttggaataagggcggcttgcagttttaagtagggtggtccaagctcactgagaaggtgacacttgaggaaagacttgatggaggtaaagaggccaaccagggagtagcaagagcatgtgcaaaggccctggggcattactgtgcccattcataggtgggataaccatggaggctgaaacagtgggagtgaggggagagtgacagatgacgccaaatgaggtacagggaagggactttacaaatcagctgggccttgggatctgagtcagcactttgacttctacactgaaaaataggttgactttggagaggtacttttttaaaaattacttgtttagagatgggggcctcactctgttacccaggctggtgcgggggcacagtaatagctcactgcagcctcgacctcctgggctcaaatgattctcctgcctcagcctccctagtagctaggactacaggtgcatgccactatgcttgacttatttattaatattattgttgttttgagacggagtcttgctctgttgcacacgctggggtgcagtggtgcaatcttggctcactgcaacctccacctcccgggttaaagtgattctcctacttcagcctccctagtagctgggactacaggcacatgccaccacacccggctaatttttgtatttttagtagagacagggttttgccctgtcagacaggctggtcttgaactcctgacttcaggagatccacctgccttggcctcccaacatgctgggattacaggcatgagccattgagcccagccacctggcttattttttaaaaaattttgtagagacacagccttgcttttttgccctggctctgctcgaacttctggcctcaagtgatcctccctcctcggccttgcaaagcatttggattacaggcatgggctaccatgccgatcgaaatgtatttttttaacggaggtataattcaccatttaaaagtgtgcaattcagtggtttttttgtgtgatgtgtggtggtgtgaaggtcacccagtgggttttttgtataaatgataatgacaatcaccactaattccaggacgttttcattaccccaaaaggaagccctgtacctgttaccagttgctccccaaatcttccattccattccaggcaaccagtaatctgctttctgtctgtctctgtttatctactgtggacttttcatataaatggaatcaaacaacaggtggccttttctgactgttttctttttttttgagacgaagtgtctcccttgttgcccacctgaagcgcaatggcatgaccttgcctcactacaacgtttgcctcctaggttcaagcgattctcctgcctcagcctactgagtagctgggattataggcatgcaccaccactcctggctaattgtgtatttttagtagagacggagtttctccatgttggtcaggctggtctggaactcccgacctcaagtgatccgcccgcctcagcctcccgaagtgctgggatttcaggtgtgagccaccccgcctggccatctgactggtttcttagcatgatgttttcaaggtttatccatgttttagcatgtataagaatttcactcctttttatggttgagaagtctatcatgtagatacatgtagaccctttcgagtaaagaatatctctgggctgggcatggtggctcatacctgtaatcccagcattttgggaggccgaggcagacggatcacttgaggccaggagctcaagaccagcctgaccaacatggcgaaaccccatctctactaagaaaaatacaaaaagattagctgggcatggtggtgggcgcctataatcccagctacttggagactgaggcatgagaatcgtttgaccttgggaggcagaggttgcggtgaactgcgatcgcaccactgcactccatcttgtgcaaaagaatgagactgtgtctcaaaaaaaaaaaaagtatctttaggtaagatgccagtgttgcgttaccgcttagaagatgggagccaggatgggtgcagtggctcatgtctgtaatcccagcactttaggtggccgaggcaggcagatggcctgagcccaggtgttcgagaacagcctaggaagcatagggagaccctgtctctacaaaaataaaaaaactagccgggcatggtggtatgcgcctgtagtcctagctactcgggaggctgaggtgggaggaatgcttgagcccgggaggtcgaggctgtggtgagccatgattgcaccactgcacccagggatcatgcgtccctgtcgtttcgagcaccttgcctccctcttgacatcggagcctggaaaatttctgtgccatggctcagcgtcatctgtcttgttaatgtcagagccagaacacgaaccagctctggcttcccgtgggaccgggctctcgcttgtgtgaccacgttaatagattccttggaagaatgatctaaggaatttggaccaaatcttccaacaagaaataaaaacagctgccatctgttgagttttactgtgcttgggccctgtgcaaataaacaccctacataagtgccaacagcccttaaaagcctatcatgacttccattttatagatgagaaaataggggcttgcctggagaggtgaaataactcaaccagggtcccacagcggaaatatggcaaagtgtatggtttttatttttaagctgtatgaccttccaggaagtaacaatgaaatggcagtgctgagaccctgaaaatacatgggccgatggccagatggcagggctatttgggtaaagtgggagagacagctcccttgaatggtgagagggaggagtcaggtggccccctggatggaagatggtttcaggcagaggaaacgtcaggggcaaaggcctggcttggggattgtgcttggtgcttttgaggaatactaagaatgcccctctaggacatctctgagaaagttgatgggagaggccggctctttgggctcccggtcgttgatttatccagttcattcccagagtgtttagtgagcacctgccatgtgccagatactgccccaggtttttccacgagctccagcagctggtcagttgtggccacctggggagggcccaagcgcgtctccagggcctgtcactgctcctaggatgatgactctcactcggggcacagcagtcagcactgggcgttctgcttgcaggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggtacagggggaagctggggcgacttccgagagggggccttggggttctaggccacgaaagcatggaagtgcccccgagcgcagcctctagatcacactcccggtcgggctccatgaggcccggacaaaggctgccatgctttcgtctggtcatgcctgaaagaaagaaaacacatttgacttcttgacagagaactcgcacttgagtatatgaatcaagtttaatgcagcagggctttcccatgctctggaagaatctttccgaaatactctgttctcttcagcctgttcctccgccattcctatcctttttttaaaaaacgtagctcttgtctgacttgattgattttacaacccactgataggtcttgaccacccacgctttgagaaaccccaaccttacagccgggcgcggcggctcatgcctgtattcccaccattttgggaggctgaggcgggtagatcacctgaggtcaagagttcgagaccagcctggccaacatagtgcaacctcatctctactaaaaatacaaaaattagccaggtgtggtggcgggtccctgtaatcccagctactcggaaggctgaggcaggagaattgcttgagcccaggaggaagaggttgcagtgagccaagatcgtgccattgcattccagtctgggtgacacagcaaaaactccgtctcaaaattaaaaaaaaaaaaaagaaaaaccccaaccttacggccgggcatgatggtacatgcctgtaatcccagcactttgggaggccaaggcaggtggatctcttaagcccaggagtttgagactagcctgggcaatatggtaaaaccctgtatgtaaaaaaaaataaaataaaataaaataaaaataaataaataaataaataaataaataaataaataaataaatatgtttgaaaattagccaggcatggtggtgtgcccctgtactcccagcgactcagaaggctggggtgggaggatcagctgagcttgggaagttgaggctgcagtgagtcatagtctcaccactacactccagcctgggtgaagggagtaagaccctgtttttttttgttttttgtttttattttttagaaacaatgtagaccatgtagaatctctaaaattcctgccattgactgtgtaaggaggggtggctttctgttttgtcacacttgggcactactggaagctcctgtcacttttctgcactgttttcacattctttttccgagcattgcgaacatcccttttgaaaactccattttaactacataggcaaatcaaccgtaaaatttggtagtacaaggctgatagcaggctttgtcaaaaacaaaaaaatccattttattatgaaaaatgtcaagtgtacacagaagtagaatagcttaaagtttgtaaactggcattaaaagaaaaagaaaaagaaaaaaaaagccaagcatgatggctcacacctgcaatcccagcattttgggagaccaaggcagacagatcagctgaggtcaggagttcgagaccagcctggccaacatggggaaaccttgtctctactaaaaatacaaaaattagccagatgtattggttggtgcctgtaatcccagctaatctggaggctgagacacgagaatcgcttgaacctgggaggtggaggttgccgaggttgcagtgagccgagattgtgccactgcactccagcctgggcgactgagtgagactcagtctccaagaaaggaaataatacaacatgaaccccgtgtacacatcactcagattcaacatcggcattttttggctgggcgcagtggctcacgcctgtaatcccagcactgtgggaggctgaggtggtaggattgcttcagcccaggagttcaaaatcagcctgggcaatgagacccttaatctacaaaaaataacaaaatgggtgtggggtgcatgcctgcagtgactacatgggaggctgaggcagaaggatcgcttgagcctaggagtttgaggctgcagtgagttatgtttgcaccactgcactccagcctgggcaacagagcaagactctgtctcaaataaagaaaccaaggttgggcgcagtggctcatgcctgtaatcccagcactctgggaggccgaggtgggcggatcatgaggtcaggagatggagaccatcctggctaacacggtgaaaccctgtctctgctaaaaatataaaaaaattagccaggtgtggtggcaggtgcctgtagtcccagctactcggttggctgaggcaggagaatgttgtgaacccgggaggtggagcttgcagtgagccgagattgcgccactgcactccagcctgggtgacagagcgagactccatctcaaaaacgaacaaaaaaacccaaaacattttgccacagttgatttatctcattctttttcagtatccctcccttgtccctctttcccttcatttgtttttaatgctaaactctgctatctatcccttcattctttcctttctttgccgaataattttaaagcaaatctcagaccccttacattctacccacaaatatttcagcatgcatttcttcctacataatgtaataccatcatcatgtctaagcaaactaacaataagtttttacaataatactcagcccatatccaagttttctggaatatctcagaaatgcctgtcccattgggctgtttgaattggctctgttgcatttgctgttacgtttccagagtcccttttccaccaggcctctgcccttttcttcttttatttttatttttatttatttattttttgaaatggagcctcactctgtcacccaggctggagtgcagtggcatgatcttggctcactgcgacctctgccttcccaggttcaagtgattcttctgcctcagcctcccgagtagctgggattgcaggtgcgtgccaccatgccaggctaattttatgtatttttttttttttttttagctgaggcggggtttcaccatgttggccaggctggtctcaaactcctgacctcaagtgatctgcctgccttggcctcccaaagtgctgggattacaggtttgagctaccgtgcccagccattcgcccattttttctgaaataccttttgtgggcttttaaaacaaagcagaaccaaacctgtttctttttttgttttgtttaattctaaagtatacactggttctaagaaatgtgggaccttcagaaataagggagggtgtgtgcccctccacacctggggaaacccttgaaagttaaccttggttggttttgcaaaaatgctttttaaaaataactctcccctgccattgctctctgtacaggcgagtgtctccctcaaacgcctgaggatctttctctcccatgaggagctggaacctgacagcatcgagcgacggcctgtcaaagacggtgtgtgtgtgttcagtcctggcttctggaagtggccgccttcccatctcccactgggtcctccctacttgcatttctttcccttggctgccctcaggtttgactctgcccagccgcttgtctgcgagaccccgggggacaagggttctgcagagcctgcagaagggaagggaagcctggcctcctgggcttctgtcctgtctcacacttcccaggagggtgaacttgcacttgcatttttgttttcttgctgagggtcagcagctgcttgaggcttccccgtgggagtcactttccaaggctttgaccttgattctattctgggctaaatgaggactctggaggctggccagcctccatcacccacaagctgtgtagacttaggtctgagcctcagttttatctagataagggaaacaaaagtacctttctttggctgagtgttacttggatttttttttttttttgagacagggtctcattccatttcccaggctggagtgcagtggtgcagtcacagctgtcactgcagccttgatttcgtgggctcaggtgatcctctgaccttagcctcccaagtagctagaactacaggcacacacagcaccatacttggataatattttggtatgttttgtagagacagggtttcaccatgttgtccaggccggtctcgaactccttagctcaagcaatccacctgcctcagcctcccaaagtgctgggcttataggcatgagccagttctcctggcctttttttttttttcaatattaaattgttttatttggagagacaaggtcttgctttgttcctcaagttggtcttgagctcctgggctcaaggatccctctgcctcagcctcccaaagtgctgggatgacagatgtgagccactgcacctggccatgcatttttattggcaggtttgtttgttttgtagcttgttaatttatcgtttcccagcccatccccctgagccagggatgttgtttgtaaccatctctctaggcacttaataataaatattaggccgggcacagtggctcacgcctgtaatcccagcactttggggagctgaggcaggtggatcacttgaggtcaggagttcgagatcagcctggccaacaaggtgaaaccccgtctctactgaaaatacaaaaattagctggacatggtgttgggcacctgtaatcccaactactcgggaggctgaggcaggagaatcacttgaacccaggaggcggaggttgcagtgagccaagatcgcgccactgcactccagccagggcaaagagtgagacttcatctcaaaaaaaaaaaaaaaaataataataataaatattaatggcactaagtgcagtgacacgttcacttataaagcctctgtcatgcacatgccattccaaggatgtcaatgtcccaacttgtccattactcaccatggtacccctggaggagggtgatggaaacccccattttccagatgaagaaactggtctctgaaacttgcctgagattgcacagctgatcaaaagaagaaccagcattcacacccacagcccatcggtagagtccatgctcttcctggccatagggtgttgcctcactgagatttactgagcacctactatgtgccaagcattgtgagaagtgctctgtgtgcactgcctcatagacaccccatcacagccctctgaagttgattgcatgattgtcagccttattttacagatgaaaaagtgaggcacaggctgggtgcagtggctcctacctataatcctagtactttgggaggccaaggctggaggattgcttgaggccaggagtttgagaccaccttgggtaatgtagtgagacctcgtctctacaaaaattaaattcaccaggcatggtggtgcacctgtagtcctagttacttgagaggctgaggcaggaggattggctgagcccgggagttcaaggctatagtgagctatgatcatgccactgtactccagcctgggtgtcagagtgagaccctgtctcaaaaaacaaacaaacaaaggcacagagaagttaactaacttgcctgtggctacccaggtacgaagtggtagccccaggattcaaacccatacagtctggctccagagtccaatgtcagaagattgaatgtgtgtaaacgtcggttataccgcgtgagctgtgtctggcacctcgcaggcgctcaggtatctttagtggcacctaaaacgtttgacacgtttgacacagcacctggtgcatagaagatgataaacagatcctgggagttgtcacttctctggtctgagcgagatggtctcagcatcttcagctcagccccctggtgtggggttttttatcctgggcgctactgacatctggagacacattgttctttgtggttggggactgtcctgtgcactgtgggatgttgagcagcaaccctggactctacccattagatacagtagtatccatcccaattttggcaaccaaaaatggctccagacattgccagatgtgccttgagggacacagttacctccagttgagaaccgtggcccaagtggatgctggactcttcctcccaacactcctgggctgtggtcatctggtttctgctgtcccagtgtcccacatcccctcacatcataaggcaatgattccatctactctggggtcaaatttctctgctaaccacaggctgaaatttgaggtggccggcggtgggtggggggtggtttcttggtactgaagttgttcacagctcaatgcaagcatcaggaaacccctaggcccctgggtgccgcccgcaccccagcccctccttcctgccctaatagtggcctcctaggtggttggacttcctggaatgtttagcacgctctagccagtgggggcccccttggctgctcccagctcccaagctaaccgttctctgcaacctctctgtctccagtggcttttcttaaattccttaaatagcaactcccagtttcctcattccacgtccactcgtagaagagctgagggagaaagttaatctaggttaaccagcaccttcctctctctctaggttttttgtttttttgatgcatggaggaagttatttcttcatttgacaacttaaacaaaaaatactcctgtattatctccagatggtcttaaggtggctcataattcagagagctgcttttctgttttttctttttctttttttttttttttttgagacagagtttcactctgttgcccaggctggagtgcaatggcacgatcttggctctctgcgacctctgccttggtttcaagcgattctcatgtctcagactcccgagtagctgggactacaggcatgcgctaccacacctggctaatgtttgtatttttagtagagatggggtttcaccacgttggccaggctggtctcgaactcctgacatcaggtgatctgcccgcctcggtctcccgaagtgttgggattacaggcatgagcccctgcgactggcctgcttttgttttaagtgagagacatgaagtaaaaggaaaataacaggaagaagagtaaaagaagacagaggtgctaggagctttagaagtgtggagctggccgggcatggtgtctcatgcctgtaatcccggcactttggaaggccgaggcaagcagatcacttgaggccaagagttcgagaccaggctgagcaacatgtcaagaccccacctctacaaaaaatacaaaaaaaaaattagctgggtgtgatggtgcacatcctgtagtcccagttgctcaggaggctgaagtgggagaatcgcctgcgcctgggagatggaggttgcagtaggccgagatcgcaccactgcgctccagcctgggtgcagaagccagatcctgtctcaggagaagacagaaacatggaaccagttaacgtgggctttgtctccgacactctccccttccctgtgccctcgtaccacacttcctgttccgtatcctctttttttgagtttatcgtgatggatgttttagaaagatccacctgctgtgatgtgctgtgtgtagagtggtgtggctgggggaggaagacagaggacctggggagaagggtgaacgacctccctttgcacctcaaggagggcccagcggtctgatgctggccaccccagtggagagaggtttgcatgtggacgccagctgtttcccactgaccttggccactgctcggccctcccagctggagctgccccgaacctgcctgagaagggccagggcatcgagagcattgagtaattctcatgcggcccccgcctctgcagtcatctcccaagatgatcgtccagatggcgcaaccccatcttacaaggacaaagctgcttgcagtttccttctgctttctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactttcaggtgcggtgtgatccagggactctgccgtcagaactttcttcatattttctgtgtttcactttctcctggtctgctttatcctcacgcatcctctccccttgtgatggtaaatggtcccaacagctcccactgtgtatcccactgttaggagaactgcctgcttcttattgacccagattgggtcctgtgccctctgtgaggcaatcgctatgccttcagacactgagtgtgctgattggccagtctcagtcaggggctgtgatgctgctgaactccagtgcccctcagctgcccagctcaccctttcttgccagctttctatctggcaccccacaccctacagtccttacctttccaaagcacatgatgtctaggaaattgaccttatccccaggcaacttgtcaagcacctctcattttgttctgaccagaggccttgatcaacagctttttaggcccccttaaggaatccgcaaaacacaggggtgatgggacccttttagaggtttagctcatgcctgggtagccaaatcactgctgtattttatgatgaaggagagaaactctccagagaaaacaatctgtagaaggcctgcattgaaaattcatgggggtactgcatgcttaggaagttcttccttatgtctaacttaaatcctgcctgcttcaattgtagctgttctgtcttgttgagctgcacaactaatctgtatctgtgtccctttcctgacccagtggttttcctgttcagttaccttccccccatgagcccccagaacctttctctaacccttttctctcatcagcctgtaagaatatttcagtctcacgtggacagtggcaggtactgtctcacgtggacagtggcaggtattgtctcactgggcttcctgcccactcaggccccataatcctttcccctcccagcacaggaacaaaaagcctgatgagtgtcaccatgcagcagtgtcataagaatgaaacaatcagtgacagcaacgactatcagcatttccactaatactctgaaatcagaaaggtggcagttaaaaagcacagaatcccagcactttgggaggccaaggtgggcacatcacctgaagtccgaagtctgagaccagcttggccaacatggtgaaaccctgtcactactaaaaataaaaaaactagctgggcatggtggtgcatgcctgtaatcccagcactttgggaggctgaggcgggcagatcactggaggtcagcagttcgagaccagcctggccaatgtggggaaaccccatctgtactaaaaatacaaaaattagctggatgtggtggcgctcgcctgtaatcccagctacttgggaggctgaggcacaagaatcatttgaacctgggaggcacaggtttcagtgagccaagattgagccactgtactccagcctgggccacagagtgagactcttgtctcaaaaaaataaataaatacttaagtaactaaatacagataaataaaaaataaaagcacattccatataagtgagtccagcaaaggtttggatgtgccctcccttccctgggaggatggaaaccctgctctggaggtgccgtcggcagtgggagtggcctggggttgacctgccccattgacagccggtcttactgggtgaatgctgagcttattttattttgctttctgctgttcgttaaaggatgatttcaatagagacatcttcctgaaattcaactcagatttattcatatgcgtttcccttttcaaccctttggtggctcccggctggcagagttcaggtgtcttagcacagcgtccttccagggcatatttcaaggtgctcccaggtctggccactacctacctcagtgccatcgcatccctggttacaccctgtgccttcacccctttacacctttctccggctctccacatgtttctgtgtgtgggacactcctgctttttgtcagagttttttggtttatttattttctgagacagagtctcacgctcttgcccagatcggagtgcagtggcacgatctcagctcactgtaacctccgcctcttgggttcaagtgattcttgtgcctcagcctcctcagtagctgggaccacaggccctgccaccaccacgcctggctaatttttatatttttagtagaaacggggtttcaccatgttggccagactggtctcgagctcctgacctcgtgatccgcctgcgttggcctcccaaagtgctgggattaccagcactggcatgagctaccgtgtccggccccagtttgtcttgaggtgtcctctcctttcagaccttgcgtcatgcccccagtaaagtttctgcctctccgaggggcaaaaactgttccagaagcccactgtgacaggatccctcaggttactccctgcctcacttctctaagggacacctgtcacctgcctcccacctggaggccccctgagacaggtcactgaactgaactcagcagtagaaatggaaggaatgttgaggccttcagtgtttagtacagtcttgccttctgtctttctctttctctacttggggtaaattgaggctcggtggccatgggcattagcccggcaggcctcattcagcgtggctgagccaggtgtgttgtgtcgtttcagcatcaccttctccatccccgaaggtgctttggtggccgtggtgggccaggtgggctgcggaaagtcgtccctgctctcagccctcttggctgagatggacaaagtggaggggcacgtggctatcaaggtaggatgaggaccagcggggaggggcagtggggaagctggtggtctgaggaaaagctcagaaatgatggtgtttcttttgactgtccctgtgccagaagcgaaagcagcaacgtctcttttcctcctcctcctgtatctttccactgtctctttctctctcgttctttctgttctgttccgtgctgtcctagaaggcaggattttggtatcatttatttccatctgtctcccagcacttaaaatagtgcccagtatatagtaggcacttaataaatatttattttgttacctctttattaagctgttattttattattattattatcattattattgtgtttttttttttttgagacagggtcaggctctgtcccgcaggctggagtgaagtggcgtgatctcggctcactgcagcctctgcctcctgggtccaagcgattctccctcagcctcccgagtagctaggattacaggcatgcgccaccatgtccagctaatttttatatttttttagtagagacggtgttttaccatgttggccaggctggtctcaaactcctgacctcaagtgatctgcacacctctgtctcccaaagtgctgggattgcaggtgtgagccaccgcatttggccacttaagaaatacttagtagacacacgaagactccctggtacgcagcctgtgtctccttcccttgcgtctctgcctgtcactgagtgtctcttggtctgtttgggtctttttggattgttctttatctttatggatctctgagtatctattcttataaatgtaacaaaacaaaaatgtttatgtggttggaatattttcttagaacattttttaaagggaacagtttaaatttttagtgttgaattcttaatatggagctaaaagaagactgcagttttactgcttttaaatacacagtgtactttgaagtaagttgaaattccccaggagtgagcttaagaggctcctttacaaataatccccactggaaatcaacagcctttgtttgcatttagttcactccccatgaaggccttttcctagtgtaacgacacgtccctggaagttttgctaccagcatttccaggagtgtggtctgcagccagctcatcttgcaggacatttgggcgataaagaaccccaggctcaaagaagcgtgggaaataatgcatactccagccccctccctcttggagacttacagtaaacattagcaaattaaaggctctgacaagtcctgcaaggagaaaaaatctattaactgtttaaccttatgtgtcccaggtgtacttgtccgcacctctttagtgtctgtgcaactgcacatttgtctcttggaatctgcctttgggaatgtcaagtttatgacgttgtttgttgttgtgggttttgagacagagttttttttgttgcccaggctggagtgcagtcgtgtgatcttgactcactgcaacctctgcctcctgggttcaaccgattcttctgtctcagcctcttgagtagctgggattataggcacccaccattactgcacccggctaatttttgtattttcagtaaagacgggattttaccatgttgacctgggtagtctagaactcctaacctcaggtgatctccccatctcggcttcccaaagtgctgggattacaggcgtgagccaccgctcctggcctagttaatgacattgtttttatttcagagcaaaaccctttctttgattatacagtgcctttagaaagtatacattgtggttgggtccaaattaatgacctttagctgttgttttaagaaatgttttatcattactttcaagttcctgccataaaataagatgaatgaaccatgagagctagattaatggaagaaaattccaaatcccgatgggatccacattgctttctgtttccttaaccccagctttctgctatcctggcactattagcatttcaggccagatgattatttattattggttgtttggcctaggtaaggggagtgctagaaatgtatataaaatatttatcttttcccaaatgttttagttggtgtggtttgtgtatattatgtctgaaatttctgtgggttctatggtaaggcaccactgttgacattttggctttttaaaagttaggatattcaagtcagcaggttaattatttgagaatttagagtaagaatgagggtacctgggacctgctgtcagctttgccctctctagaattcccttattcaagaatcttctggctgggcgcggtggctcacatctgtaatcccagcactttgggaggctgaggcaggttgatcacctgaggtcaggagtttgagaccagcctgaccagcatggcgaaaccccgtctctactgaaaatacaaaaattagtgggcctggtggtgtgtgcctttagtcccagctactcaggaggctgaggaaggagaatcccttgagcccggaggcagagactgcagtgagctgagatcttgacactgtattccagcctgagcgacagcaaggcttcgtttcaaaaaaaaatcttcaggggctccccttgcccctctgataaagcccatgctccccaccaagtataggcccccttgctgtccctggtgtgttttctgccagtcgttccctcacaggattgatcgatgttcctgtcacgctggcctttctgttccttgaatgtgccaagtacttttcacttccaggccttcgcatgtgctgttccctcggacttgaatgctcttccctcttctcctcatgaaactgactcattcttcactttttggttcttgtctaaacatatgtttgagctgagcatgatggctcatgcctataatcccagcacttcaggaggccaaggcaggaggattgcttgaggccaggagtttgagaccaggcttagcaacatggcaagattttgtttctacaaacgtaataaatatatagagaattaactacctcagcattttcattagcaaaatacacaaaacaaatatccttactctagcctttattctcatgctgtttgtgatacctgacatatggaaataaaaataagcctttgaaatggatgcttgatataggagtctttgcttcaatttttagcaaggatatttcctcaaagatccttcccggatgtcccaaactaggtcagtcttttaatttttttgagacaggatcttgctctgtggtccaggctggagtgcagtggcacggtgcaatctcagctcgtggtacctccatttcctgggctcaggtgatcctcccacctcagcctcccaagtagctgggactacagatgcacagcgccatgcctggctaatttttctattttttttagagatgggatttctctatgttgtccaggctggctttgaactcctgacctcaagcagtctgcctgccttggcctcccaaagtgctgggattacaggcatgagccactgcgcctagtcaagttagactcttaaaaagtgtcatatatctttttatctttgcgtccaccgtaactgtaatcaagtagttttccgtcacctgagggacttccactctttggaagcaggggttttgatcaccgctgtaggcattgagttaatagctagctactaagtaaataactgtaatcttatcaacgaggatatcaactctttgactcctgatattggagtcagtgattcacctgctgtgggttctgatcccagccctggcatctgttgtcctttgtgagtcagtttccctcttgccaaagcaatagttgtgatgaaaatgacttgtgaagtgaggccctcctagcaggcgggtgggccagctgttgtctcgttgatcagatctgtctgtgtgtctgtctcacctcgttctccatttgcaacttagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaaggtcagtataggttggatgttggcccctgaatcagtcagctgttgccgcgtaacaaatgctctcacaatctcagtgggctgtgagtctgctgctatcagctgacccggcagggctcagctgggcggctctgctgcacgctgcaggccagctgaacttgggtccaggctgtgggtgtggctcaggtctcacttacagagcttttgctggggaccggggtgaggggtccacagctttccaaaggggggctcttctcatggtggcagcagaggcccaagataggccccccagaaagcatgcaatgtcccttaaagtacactgtcccttctactcacaaagcaagtcacttggccaagctcaaaggcaagggaccaagaaggaagtacattctacctttgtggtcacatgactgcagagtcacatgacagagggcatgctgttgggaggaggggagtcgatgattcatatgttcacagtccctgtcaagatagccataatactgaaaatagcacaatagctaacacttactgagcattttctctttcttttctttctttctttttatttatttatttatttttgagatggagtcttgctctcttgcccaggctggagtgcagtggcacgatctcagctcactgcaacctctgcctcccgcgttcaggtgattctcctgcctcagcttcctgaggggctggaattacaggtgcatatcaccacactcggctaatttttgtatttttagtcgaggcagggtttcaccatgttggccaggttggtgtctaactcctgacctcaagtgatccgctggcctcagcctctcaaagttcttttttttttttgaaatggagtctctctctgtcgcccaggctagagtgtagtggctcactcttggctcattgcaacctctgcctcctgagttcaagtgattctcctccctcagcctcttgaatagctgggactacaggcccctgccaccacgcacagctaatttttgtatttttattcgaggcagggtttcaccatgttggccaggttggtgtctaactcctgacctcaagtgatcggctggcctcagcctctcaaagttctttttttttttttgaaatggagtctctctctgtcgcccaggctagagtgtagtggctcactcttggttcaacctctgcctcctgagttcaagtgattctcctccctcagcctcttgaatagctgggactacaggcccctgccaccacgcacagctaatttctgtatttttagtagagatgggatttcgctgtgttggccatgctgatcttgaactcctggcctcaggtgatctgcccgcctctgcctctcacaatgctgggattacagatgttaaccacctcgcccggcctataacttgagtattttctgtatgttgggaactatgctaaacattttacacgtaattcttccccacagcaagcccatgggtggaatttgttgttatacctaggtaatcattgaggaaaaaggaggcacagagaggccaagtgacttacctgaggccacacagccacagagctgcagagagcatggttcctgtgtccatgttgttacctgctcattttgtcatctctaaaagggccattctctgcctctcaccactgcagaccctccctcctgctgtgctccatctcccaggttttcctgctgcttcacagcaacccccagcccctgcccacctccacaccttggtctgagccttcaaggcctggggtgcctcccctgctgcttgcctggccactttgctctggcaccccatggtggtcgtctggtgtgtcccctcttggaagaccaagagtgcaaagcactggcccatttctgtttttagttacaagccaggggctctgtcggctttcttacgtggtgaatgatgtttaaaaattgagataagcctgcagctccttggaaataaaaaacgaattattggctgggcgcggtagctcacgcctataatcccagcactttgggagaccaaggtgggaggattgtctgaggtcaggagttcgagaccagcctgggcaacatggtgaaaacccacctctactaaaaatacaaaaagttgccaggcatggtgccgtgcacctgtggtcccagccacttagggggctgaggtgagaggattgcttgaacctgggaagcggagattacagtgagctgagattgtgccactgcactccagcctgggcgacagagtgagattctgtctccaaaaacaaaaagaaggcacgtggctgccaggaccccacctcagtgcatgggagtcagggcaggcatctcaggagggactgggcagtaacctgtgatttccagccaaatagggaaacgacgttggcttatctgtcatggtgggagctggcgctgctgctggtccatgcattgtccttcctcctggtgactgggatgtgggctggatttcagcatccccaggccggagccttgcttcacctatatgtggctttgccagacagtgacagatccagagtaagctggcaaacatggcagctgtcaccaacagcagcagtaacaataatatgaccacgtccaccagcgccttccatgagactaagggatcacggccttcccactggtcaacatgatttggtgccgtcagccatcctttgctgagcacttgctgtgcaccacgtgccctgctcagcacctcacgggagattcaggttttctcttttgcccagttgacaggtggggctaaaccctgtgcctgtgatcccatccttggtggtggtggagctggggcctggctccaggtttgtgcaggcgtgacctcatgccttcagcatcaaacttaaagaagaggaggtgggtgcagctctgcagggccttcacccaggacctgctgtgtcctgagcaggctctatgcctttctttctttcttgtttaaagagacagggtctcattctgtcgcccaggctggagtgcagtggcccagccatagctcgttgcagcctggaactcctgggctcaagccatcttcccactcagcctcctgaatagctggaactacaggcgcacatcagcaggcttggctaattttttcttttcttttcttttctttttttgtagagacagggtctccctatattgctcaggctggtctcaaacccctggtctcaagcagtccttccaccttggcctcccaaagttctgggatcacaccacactcggcctgcttctacgtattgtgagtctcaagatttcccaggaaacccactcctgtgtgtgtctctccccagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaaggtgcctgctggcggggtggggcttggtgttgggccgtctcgccctttggttaagtcagaacgtgtcccctttaggagtcctttactttctctggctttctttgtttttaattggactttaaagaacacatttctcatgcttgtcttggaagccttcctaagacagccgtcttgtacttgtctttataggggtaagtcctccgcgcagagttaaattcattgcctctccatggccaagggaggcctctcttcctgattaagtcacagggctggcttcttagcggggaatcccactccaagacattgcctgtgacctagcaggctgcattttcttacttgcagaggtgtctgtgggtagaggggtcggaaaattgccacaacaccttaacataataggaaatagttcctgtgttctttttatagggcagttgtggtaatgggtacacactggctcttttttttctccccctgattttatttttttgaggtggagtttcgctactgttgcccaggctggagtgcagtggcatgatctcagctcactgcaacctccgcatctcgggttcaagcacttctcctgctttggcctcccaagtagctgggattacaggtgcccaccaccacgcctggctaattttttttatttttagtagaatcgaggtttcaccatgttggtcaggctggtctcgaactcctgacctcaagtgatctgcccgcctgggtctcctgcaatgctgggattacaggcgtgagccaccacacccggctgtttctgctgattttaaaactaacacatccccatggggggcatatagattaagaaaaacatgaaaaagaaaaatggaagcagttacacacattccactggttagaggttttgtatttttttcaagtctttttgctctgtgtataaactttttaaatagggttatcttgttccacgtatatatacaggaaacatcgtgctacatgacctcttgtaatcgttcccatacataccactaacattctgtgtaaacatattttaaaatagtacaaaacatttttgaaaattactaagtaatacatgcccattgtaacaaaattgaaaagtacaagaatatggatatcttcttataatatatgtgtgtatgcgtgtgtgtgtgtgtgtgtgtgtgtgtgcatgtatataaagtaaataaagctgggcacggtgagtaatcccaacacttttggaggcctagaccagtggatcacctgaggtcaggagttcgagaccagcctggccaacatggtgaaaccccatctctactaaaaatacaaaaatcagccgagtgtggtgatgcatggctgtaatcccagctactcgggaagctgaggccggagaatgtcttgaacccgggacgtggaggttgcagtgagctgagattgcgccactgcactctagcctgggtaacagagcgagactccgtctcagaaaatatatctaaataaagtaaataaaatagtccctcttcatcctgcatccctaatctttaattcttctcttagagagcaagggttagcaaatctggcccactgcctgctttttatatggctcttgagctaagaatgatgtgtgtatttttaaatagaagaaatctaaacaggaagaatattttatgacatttgaaaatcgtattaaatttagatatcagtgtccataaataaaactttattggaacatggccaatgtattttttttctttttttttctgcagacagggttttcctctgttgtccaggctggagtgcagtgccacagtcatggcatggtagcctccagctcctcggctgaatcaatcctcctgccttctgagtagctcctgggaccacaggcatgcagcaccatgcctggctaatttatttttatttttattttgtggagacaggtctcactatgtttcccaggctggtttcaaactcttggcctcaaggaatcctcccgttttggcctcccaaagtgctgggattacaggtgtgagccaccgcacgtgtcctgttctttaaagcatcgtctacagctgcttcaactcggcagggctgagttggtgccatggcaactgtaagatccataaagctgaaaagattgaccgttagctgtttaaggaaacatatgctgacttctattaatagtttgatgaatgtcttcccaaactttcagatttgcagataaaatgtatgcatgtgcatattttgtagtggttttgggggtggctgacagcgggagttgttttagaaaaaaattaagccagagctgggcacggtagcgcatgcctgtagtcccagcacttttgtaagccaagggcgaatggatcgcttcagttcaggagttcaagatgagcctggacaacatgatgagacccctgtcttgacaaaaaatacaaaaattatctgggcatggtggcacgtatctgtagtcccagctacttgggaggctgaggcaggagaatcgcttgaacccaggaagcataggttgtggtgagccgaggtcgcaccactgcactccagcctgggcgacagagcgagaccctatctcaaaaagaaaaaaaaaaaagaagaaaaaaattaagccattgggctgggcgcagcggctcacacctgtaatcctaaaactttgggaggccaagataggcagattgcctgaggtcaggagtttgagaccagcctgggcaacatggtgaaacgccatctctactaaaatacaacaacaaaaaaatcagccaggtgtggtggcgggcgcatgtaatcccagctacgcgggagggaggctgaggcacgggaattgcttgaacccgggaggcggaggttgcagtgagccgagactgtgccactgcactccagcctggacaacaaagtgaaactctgtctcaaaaaaaaaaaaaaaagccattgcatacaaactgttttgctgtggcaccatccttttattcctttacacacttgtatggttccctccctacctcttgtcattcaggtttttgttaaaaaataaccttccccattacctttgttaaaattgcaaaacccgcacacttggtacacccgttcccctttttgctgtgtttttgccattcagcaagcactattctactagtgttcgtttctcctgcggccctggaatctggggcaggggtctttgtttccttccccttccccagcttttagctcagcacctgaggcgtggcaggccctttgcacatgcatgttacaggaccgtgtgcacaggttcagctgctcctggatgctgttatcgcgggtgcatgtcccaccttcagacctgagttttgcccaccaggtgttcgtcggctcattcctcctttagtcttcactctgccaagctaggcagtctcacacatgtgcactcacgtggccgggtgtcccctttgcccacagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggtaggggcagccccagggttccacccactcagggtgtctggcaccttgaagggccacattggcctctttgaggttgccaccagccacttggggaaggcggctcctcagggcatgagggtgggagctggatggagccccctaaagaagcaatgtggaaaaccaccttagtccctgcagtgctgaactgggagagagtctcggtgctttatggccaggggatgggagcaccaggcttcagctcagctgacctcagggcagggtctagcgccttcctggaacatgaccttggacctgatgagtttcagggtccttatggcaaaaatgggaatgatggtaattaaagtcctggctctcggggctgagagaaactgaggacatacgtgacacaagagatgtgagggttgtgaggtgaagcacggagttaagctggcaggctcgggttggtgacgtctgggttcaatccccggccgctcatctccccagctatgtgacctgaggcctgcccttcagacccatctgagcttcactttcctccctcataaagcagttcagcagggccagacgtggtggttcccagcacttgtaatcccaacacatagagaggctgaggtgggaggatcgctccagctcaggagtttgagaccatcctcagtagcatggcgaaacctcatctctacaaaaaatacaaaaaatttgccaggcacagtggctcacgcctgtaatcccagcactttgggaggccgtggtgggtggatcccttgaagccaggaggaattcaagaccagcctggccaacatactgaaaccccaactctacaaaaaaaaaaaaaaaaaaattcagatgctattaagtgctttggaggggaaacaaaaaagacaatgccatgggctgaggagtgatgggtgtcattgtggcaactcaggcaggggatagggaaaccctctctggggaggttgcattggcatgggaaggagccagcagggagaagatctgggaagtgttgtgggcagagggaacagccagtacaaaggcctcaggaccagcatgagctcaatttgtttacaaaacaaaaagggtggtgtggccagaccatggtgtgccaggacgtggggggcaggagaagaggtcagcacagtgattgtcctgcagggccttccaggtgggttttggtctaactgccctgggaagccactgagtgtcagagaggcaaagtgaccagccccaggatacacagcagctgctggcagggttggttctcaagttggtctctgagtttctcatcctttgcctggggtgggagctccttctctgcagaggtcctagtgatctctaataagtgctttcttgagatgtaattcacacacgtaggctgggcgcagtggctcacgcctgtaatcccagcactgtgggaggctgacacaggtggatcacctgaggtcaggagttggagaccagcctggccaacatgatgaaaccctgtctctactaaaaatacaaaaattatcctggcgtggtggcgcacgcctataggcccagctactggggaggctgaggcaggagaatagtttgaaccttggaggcggaggttgcagtgaaccgagatcgtgccactacactccagcttgggcaacagagcaagacttcgtctcagaaaaacaaaacaaaacaaaacaaaaattcatacaacatacaattaacccacttaaatcacaaaatccaaccatcaccacagtcaggtttagaactttttttaatcacccccaaaagaaaccccaatccatcagccatgactccctattttccccagcacctccgaagccctaggcaaccactaatctttctgtctctctagatttgcttattctggacatttcatataaatgccatcacaataggtggaatgttgtgactggcggcttttacacttagcgtggtgttttcaaggttcgtctatgttgtagcttcatttccttttattgcggaataatatgccattgtgcagatagaccatactgtgttgatctgttcactggttgatggacattcaggttttttccactttctgactcttgtgaatactgctgtcatgagccctggtggttttaaaggaaaagttggtggccgggtgtggtggtttgtgcctgtaatcccaccactttgggaggccaaggcgggtggatcacttgaggttaggagttcaagaccagcctgggcagcatggtgaaacctcgtctctactgaaagtacaaacattagctgggatggtggtgcacacctgtagtcccggctattcgggaggctgaggtgggggaatcgcttgagcctgggagtcaggctgctgtgagccaaaatcatgccactgcactccatctggcctgggtgacagagcaagaccatgtctcaaaatacagttggatttttgtttcttgccagtgcatgatagctgacattcccttcagcttttaaattatttgattagactgaatttctgcatgttcattcccttgtggttgggaagttctaccttgagtctagcctgtttcttcttgctgcagaatccccctttgtctatctctcagcccgagcaatgcattgtggcaacttctcggtgactttttcactgacctgcttggcaggctacttttaggtgacaataccctttgtgctctctaaatcaaaatgtgtgggtttagctgaatcttttgcccagcgtgaggtctgtctctctacccttccgtccaggtgagcaaaaaatgtccttaaactctcttggccccagataggttccgcacccccgcctttctttcccagctgctagagtatccaagcagtgtatacagaacatggaaggctgccagatgctttgtgatttttgtacacatcagcacttaatttggtgatgcaaatgccgcccaccaccctggcacctcgtgcgttcattttcccagtttgacctccctacctcctgcctttgaggttacatagaagtccttggcagtgggtcttacatcaaactggggcacccccctctctcaccacccacccttttccattgctctggaggggccctggctataaagtcttgacatcagggtctggtcttgcccagccttagccaactcgaagcgccaatgaccttgggtttgtttaaaccacatttttggctcttcctaaaggggaacttttttccttgttggattaatcagctcttttttttagaacacccaggctgaaggggtgcaggtgttggtatttggtttgggagaatccttgaggggggatgggcaggaaccaggcttgtgaatggggccataccgacctctctcccgggatattcagtttactgatttctaagaaatatatcttttttactgtttgtctccctctctccttttttttttttttttttttttaacttttaatggcattccttttattcctaatttattcccatgccataagcttttgtttcttcaatttcttctgggatatatttttcttctgtgcagcctccccttccggtttaggaacagtttgttccctttcaggcaggatcatctggatgtggcagagtgagctcacgtatgggttaatccgaccgaccctgagctctgtaggtccggcgacgcaacttaggtgctttcttcagttggatatgctcaaggaccagagaatctgcatctgaacccttaagttcagtgtgactctctgtatttttaagcatgtgcagcagaaattcagtgctctttttgggccgccgaccttgtggccagccccacttcttggcctgggtacatctaccaactccaccattataatgtcagaatggtacatgttgtttctgtaaagtggcatctttctgatactttgtggccttttgtacgtgcatacctttgatggcctgggcgctttcaggagtgttctttttctttttcttttttttgagacggagtcttgctctgtcgcccaggctggagtgcagtggcgcgatcttggctccctgcaagctctgccgcccaggttcacgccattctcctgcctcagcctcccgagtagctgggactacaggcgcccgccaccatgcccagctaattttttttgtatttttagtagaaacggggtttcaccgtgttagtcaggatggtctcgatctcttgacgtcatgatccgcccgcctcggcctcccaaagtgctgggattacaggcgtgagccactgcgcctggccttttttttttttttttttttttgatacagagtctcacttgttgcccaggctggagtgtagtggcacgatcttggctcactgcagcctccacctcccgggttcaagaaattcttgtgcctcagcctctcgagtagctggagttacaggcatgtgccaccacgcccagctaatttttgtatttttagtagagatggggtttcaccatgctgaccaggctggtctcaaactcctggcctcaagggatcctcctgcctcagcctcccaaagtgttgggataacaggcatgagccaccatgcccggcctcacaaatgttcttaaggtgaacacgaagatttgaacctcttgatctgcatgattctgtggtgttttctggataaagtgaatagtgaaccattttcacagattgcctcaagccccttaggggaacaaatttttaagggatttaaaaaaatggctcattaaccttcatacctggaaggtaaaacacatcttcatgactctggtttctttcttaggaacctaatacctagagcagtggttttccatcaggggcaaattgcccccaccctggggacagttggcaatgtttggagacatgttgggatgtcaaaactggagtggggtttgcccctggcaggcaagcagggtagaggccagcgatgtcgctaaacatcctacagcactcaagacgaattcccccttaccctgccccccgtgacagggaatccccttgccaggacatccaaagcaccacgagcaagaaaccctgtgtgctccgacttcacactgctgaattcttcccttgtcctcttgggagaaggatctttattccaacaatgtggccatttttctcttttaaaaaattttatttatatatttttatgtttttttatggagatgggatatcagtctgttgcccaggctggtctcgaactcctgggctcaagcgatcctcccaccttgacctcccaaaatgcaaatgctgggattataagcatgagtcgcggcacctggcccgtggccatttttcaaaaccttgcttgaaccatctgttaacctcatggcaaatatttttccctcttaagtatttaccgagtttttcttaatgattataaaagcaacatgtgctcatcgtagacatttgcaaactacaaaagagtacaaagaatcaggaaaaaaggtggctcatatgtgtaatgccaggactttgggaggccaaggtaggcggatcacctgagggcaggagttcgagaccagcctcgccaacatggtgaaaccccatctctactaaaaatacagaaatgtcaggaggctgaggcaggagaatagcgtgaatccggggggcagagcttgcagtgagccaagattgtgccactgcactctagcctgggtaacagagcgagactgtctcaaaaaaaaaacaaaaaaacaaaaaaaaactcccgagaaagaacatctttctgccctcactgcccagaaggggagctgttgttagctttggcatctttttcacctgtccttccttcctaggccttctcccttgacaagattgagagtatatcttagagttttctcatctcctgccaccttttgatttcttttcttaacagtgggccataagcacctccccaagttacacaaattagttgtcagcacagagcagctgccgagagagttcatcagacagacccccacattccttctggctgtcctcagaggccggatttcttcctcttttgaggatgaagagctttctctgccgaggctgggggaggaggtcagtgaggcagccagtgaatgccgtttttggtcaaaaatgaggcgttgactataaagctgtgagttgaattcttccctccggggaggctggcctgctggaccttgcccaagcagagttccagaaccttcttgagtaaaggcagtgttggtggaataaacagtgagaggactggcaacggaatacacagacccggggcagcacttaacgtacgtgggtcaagggtagaaacagcacctggcttgacagcatccaaaacccaacacctggtggttgcatgaactcagtgacagtcactgaattacaagtttcgtgtgtttgctttaaaaaaaaaaagaaagaactcttgctactttatagcattctccaccctggcccccagccttcatgtccctcttcttccctgctttgattactttgtggcacttattgctgcctggagtaaattatggatctacttgttcatttattgttgatctcttcctttggaatttaagatctgagggttttgtttgtttgttttgttttgttttgtttgttttgggagtctcacgctgttgcccaggctggagtgcaatggtgcaatctcggctcactgcaacctccacctcctgggtccaagtgattctcctgccgcaacctcccaagtagctgggattacggatgcctgccaccacgcccggctaatttttgtatttttagtagagacggcgttgtgccacattggtcaggctggtcttgaactccggacctcaagtgatccacccgcctcagcctcccaaagtgctgggattacaggcatgagccatcgtgcccggctgctctgagggctttttggttgtctctccatccccaggactaagaaaagagcctgacacatagtagacactcagtaaatgtgttaaatgagtggatgaatcgcaccttggctgttcaaggcatgtcctgcataagcagtgggtaggccggagggctttggatgtttacactgcagataaatacctcagactaggagaaaataggagtggatttcaccccctctcaggtctgctttagaaagcagctttgtcagtcctgcctatgagaggggcccctctggcattgggaagtcagctctgcttcttgacttgactatacacttgtcagtctgcccatctgtctgtcgggtgtgtacagagtgcctgctgtgtgccacaaggccacctggtacgtgagcctctgtgtggaatggtgccccccacgttgagttgtgcagtgtgcatcttgtgtaactgcacttggccacctgctgtgccaggtgctggtgatacagtaatggatatgacccacttcatgcccttgagagctcacagtctgatgggagagacaaacgccaaacaattaagggtatcatagtgctaaatgcagtgatggagggctgcttgagggcctgggaaatcacagagaaggagcccccatcccagcctgggagggtccagggtgatatctgggctaagtcaccttttcttctcctcttgggcacatgtgcatctggctctgtgtggggccagcccctctcaggagcagtgtctgtcctcaaaggggctggagctgatgcccatgccacctcccagtgtcatgcctggcctgcctactgtaatactttatttcttttcctctcctgcgtaaaaacaagcctgaagactgaaggttggtctgcattatttgtttagctctatttatggttaaacacagttatgactttggccaggcatggtggctcacgcctgtaatcctagcactttgggaggccaaggcaggtgtatcagctgaggtcaggagtttgagaccagcctggccaacatggcaaaaccccgtctctactaaaaatacgaaaattagccaggtgtggtggcgggcacctgtaatcccagctatttgggaggctgaggctggagaattgcttgaacctgggtggcggaggttgcggtgagctaagatcacgccacttccctccagcctgggctaaagagtgaaactctgtcacaaacaaacaaacaaaaacccaacacagttatgactttggagaaaggggttggtcttgtgcagtgtgcttgtcccggatccacccagcacgtgtgggatggggaaactgacgcacaaatggagcagacccttcagccattcttgcctctccccctttagaaaagacactcccttcactcctttatttagataggggcttagggcgggagtttcgctttgcttcttaacaatatcttgggtcttctgaattcccaggcagcacagtgatggacgaggaggaagcaggtcagtactgcccgggttggagttggcttggctcatagaatgaggccagagacgggccgagactgtcgctgcatgtctggggaggtgccgtcagatgtctgtgttttcacccctccggttgttcattggttcatttagcacacatttactgggtacctactgtgtgtctggctttgaggctggcactgggggatacagcctgagtccccagatccctttattgtcactgatgaccttgggtaagctctactgtttcatgcatcacgttaccgtgaccagcatgccttgaggggaccatgcttatgaagtgcctggcacacagtggatggacaataaatggcaacagtttgattgtgagctgccacgcatagatcctggggcacagtcaagacacacatgggcccagacaatgcagggtgatcagcgcctgttggggaactgcagcaggtggtggtggggaccctgaagagggatgtcgcctagtggaattccagtggccagactggacccatccctcctgccttctgcagtgtgtggcttagggtcccagccaagggctttttttgtaagcagcagaagctgaatctggccaccttaaacaaacagagggtgtttcctggaaggataccaggtaactcatgaatcaaaggcagaactgagcaagtaggactcaggaaatgggaactctgggagactagactcttttaggacaggtgaacttgaactgtctttggtccttgtagaccactgatgacggttcaaatcctgggagaggggcttttatggggcgacctcagacagtgcccaccttggctgggggaatctgaggcaccctgattgacaggcccaccaaggctgtaggaagagggagagctgatcccttcaaaaagccaacagggggccaggcacagtggctcacacctgtaatcccagcactctgggaggccgaggtgggtggatcacctgaggtcaggggtttgagaccagcctggccaacatggtgaaaccccgtctctactagaaatacaaaagaattagccaggcacggtggtgcatgcctgtaatcccagcttcctgggaggctgaggtgggaggatcgattgaacccaagaggcagaggttgcagtgagccaagatggcaccagtgcaatccagcctgggcgacagagaagaccttgtctcaagacaaggaaaaaaaaaaatgctgagaggatggtggactaactgatgttcagattcctcctcttaggcgcttggtcctcctccgtgcagagtggaattttccagctgcccagttcgacctgtgggctaattggtgggttgagagggtaagacagccttagcgagcactgcatgcctgcagaagctcccagctgaccatggtggctgcgctcagtgacgaacaggagaagtgaaggctgaggcttataggagggtggcctgaggctgctggtaggagagcgggggggctctctgcggcatgcagcctccagatgggggtccctgggagtgttctggaacattctcatccctgcacagagaaagatggttaagggcatggctggttcccagtgtcacacatgtgtgtgaggacaggctgcatgggaagtcctgcttggtatcattcttccttcctgggtgatgtggctatttgtgttttgtttgttttttaagttagtgtttagttagtttagacaaaacaaaacagatgctgacattaaagggaatgtttaaagcagagtttctcagttcctggctgtgcctagaattctctgtagaacctgtttaaaaatgtatttagtaataagcaacacgggggtcgccatcactgaacacttgctgtgccaggcactgcgtgcagtctcgtttcaccctctcgcaaatgaaggttgggtctgctgttcctgttttgcagatgtggaagatgaggctcagacagatttatcatttccccaaggggcacagccaggaagtgagagaacacttcccacatatcacagttcctggagctctaatcgagactcatagcagggactgggctggacacgagggcacctgctcagtttttaattttaattttttggtttattttcttttattcgtgttttttagattttttttttatttttattttttatttttatttttagacagagtctcgctctgtcacccaggctggagtgtggtagcatgatttcagctcactgcaacctccgcctcccgggttcaagcaattctagagcctcagcctcccgagtaggtgggattacaggcatgcaccaccacgcccagctaatttttgtatttttagaatagagttggggtttttccatgttggccaggctggtcttgaactcctggcctcaagcgatctgcccgcctcggccttgaaagtgctggggattacaggtgtgagccaccgtgcccggcggccacctgctcatttataaagccccccgtgactcatttacaaccaagactgagaattcctggcatggagtgcctccctctgtccaggaatgatctgcagccccctcttcccttccaggtgtgtctgtgtctccctgtggctgtttctgcaagattttgcatttttgagctctgcttttattcatgtcatcacccgagcatgttcccagggtcaccctgaccatgctgctggctgcgtatttatcccttttgtatcttctgtcctgggtcctctcccaccttctctggggtcagccctgtggtgccttacattgtgctgctttctctcctggcaccaaagaatgaggcagtcagtgcggagtgggggcagtagtcatcatcatcactgagttattgtgaaccgggaaagagatatgatctgtgttgacacgacacacggtgcccaagtgcacttgataaatgttggctgtcattgtcattgttgatgttccggtgattattgttgatgctgggtggattcttcctgggatcagggcagatatccagctgctgtgtcccttggtgtccttatcagtgtccttcctaattctgcaaccaaggcatctgccagggctggggtctcatctgaagactcaatcagggaagggtccactttgaagctcacctggttgttggcagaacttggttccccagttcaaatgttgaaatactttattactgtggaaacagccactgccccaggtaccttttaccctgaactcttgggacctctctgtggtctaggaactgaagggttaactcctggcactacaggggtctccgggcctctgcctgttggctgatggccttgtcaaattggttatctattttgaatatcacttcttctttcaatgcttgggaatcacggggctatgccctttccctcatgcgtttccttgcatcctggtcctaggaagtgagcttaacatagcagggctactgttttctgggctgggttttacccattgctgctggcacaggatgctggctcaggcccagtgccctcagtggatggagccttctgcacagttgcaaagcactgtccctaccccaagggactgagctccagataccacctgccccacaaccagacagcctgttcatggcctctgcagagcaggtctcctactttctgatcatcctggcggccaggtgctctgtggtctcctcactgaagtggccggtttttgttgcccttggttttagcatctgcctcatataaccccacttgccccctttgtctctcttctgccaggggtcacgggcgtcagcggtccagggaaggaagcaaagcaaatggagaatggcatgctggtgacggacagtgcagggaagcaactgcagaggtaagggcggggaggaaggccccaacctaaggaccctgccctgccagtgggaggacaagaggaggaacaaaaaaaggcctcagccccctgaggtcctggaaggcctgggcttttaccttccctcccaaatcctccaaggaccttgcttttcagagtacagaggcccaaagaaggaatgtggcactctttttgccaggtggcacaactcacacaggcctcatgatttaaccagctgtccacgcttctgacactcgggctccctacatggtgtgggtctttgctcaggtctcttggcggggcctggaaggttcaggctttgtgaagcagcatttgatttaaaactgtctcaaggccaggtgtggtggctcctgcttgtaatctcagcactttgggaggttgaggcaggaggatcgcttgaggccaggagtttgagaccacagtgggtaacatagcaagacctcatctctacaaaaaaggaagtatgctcgtgtttgattatagagggcttccttagatccctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtcccagctactcgggaggctgaggcacgagaatcgcttgaacccaggaggtggaggttgcagtgagccgagattgcgccatggcactccagcctgggtgacagagcgagactccatctcaaaaaacaaaaacaaaacaaaacagcagcagcagcagaaaacagtaaaacaacaacaaaaattgacaaagtcggagcctaaacgtatcagaccgcggagatctgagaaaggatcccggacctgcagttgctacaggggtcaggagagagcaaagaccatgcggcatagcacggtgcctggaacagacaaacacttcgtagatgtcgcttttgccatggttatcatccggacatggttatggtccggaattggtgggtcttggtctcactgacttcaagaatgaagccgcagaccctcacggtgagtgttacagttcttaaaggtggcacgtctggggtttgttccttctgctgttcggatgtgttcggagtttcttccttctggtgggttcgtggtctcgctggcctcaggagtgaagctgcagaccttcgcggtaagtgttacagctcttaaggtggcgtgtctggagtcgttcgttcctcccgctgggtttgtgctctggctggcttcaggagtgaagctgtagaccttgatggtgagtgttacagctcacaaaggcaatgtggacccaaacactgagcagcagaaagatttatcgcaaagagtgaaacaataaagcttccacagtttggaagggtaccccagtaggtggccactgctggctctggcagccagcttttattctcttatctggccctacccacatcctgctgattggtccattttacagagagccgattggtctgtttttacagagtgttgattggtccgttttgacagggtgctgattggtgtgtttacaacccctgagctagatacgtaagttccccacatccccactagattagctagatatagagtgttgattggtgcattcacaaaccctgagctagacacagggtgctgattggtgtgtttacaaaccttgagctagatacagagtgctgattggtgtatttacaatcccttagctagacataaagggcctccaagtcagcaccagactcaggagcccagctggcttcaccaggtggatgccacactggggctgcaggtggagctgcctgccagtcccgtgccgtgcgccctcactcctcagcccttgggcggtggaagggactgggcgccatggagcaggggcggcactcgtccgggaggctcgggccgcgcaggagcccatagcggggaggtggggaggctcaggcatggcaggctgcaggtcccgagccctgccccgcggggaggcagctaaagcccggtgagaaatcaagtgcagcagctgctggcccaggtgctaagcccctcactacccgggctggcggggctgcccggcagctctgagtgcggggtccaccgagccgacgcccacccagaactagcgctggcccgcaagcgccctgtgcagctccggttccctcccgttcctctccctccacacctccccgcaagctgagggagccggctccagccttggccagcccagaaaggggctcccacagtgcagcggcgggctgaagggctcctcaagcgctgccagagtgggtgccaaggccgaggaggcacagagagcgagcgagggctgcgagggctgccagcacgctgtcacttctcaatcttacacagcctaaattctagtgggagactccagacagtgcatgagtgtagaaggatgtaagattttctgtcgaggtgtgtggatgtgtgaagtcctaggtcatgaagcaggaagccccagctccccatttgaattctagattccatccagagttggttccagttgctccctctgccactccctgaaaactcactcttgctttcagatttgagggccacttccacctcactaggccttaactaaagacctttgcacagatctcatgggtaaggaaagtttacccaatcccaggcgctaattcaaagaggggaggtggtggaggtttattcggccttcaggaagtgttttcaggggacacagttctgggggtgcagggatgactcatatggggctcttgacctcagttagcttataatcttgtgcaggagataagtgggtagaggaaagtatagaaatttccacggcagtgagccgcagctgtgttttgcatggtctccataatttcttttcttttcttttcttttttttttttttttgacatgagtctccctctgtcgcccaggctggagtgcagtgtgcagtggcgcgatgtcagccactgaacggaaaactgtgggcgacgcaatctgtgatcatctctgggggtctgcataaagctcatgaccactgatgtgcgaaaagtgcttttttttttttttttgagacagggtcttactcagtcgctgaggctggagtgcagtggtgcaatcacggctcactgcaatttctgcctctgggattcaagcgattctcctgcctcaacctcccaagtagttgggactgcaggtgcacggtaccacgcctggctaatttttgtatttttagtagagacggggtttcaccgtgttggccaggctagtcttgaactcctggcctcaagtgatccgcccacctcggcctcccaaagtgctgggattacaggtgtgagccactgcacctggccaaataatgctttctgagtaacacgcttgcatgaaggagcagtcaggcaagatcccaccccagtgcccaccacatttgtaaaacaagaaaatcgaactagctgggtactttgccctatgtttttcatcatatgttacattttgaatctttttcatgtttgaaaaatgatctacgatgtgccctttctgttatatcttttattggcttttttttttttgagatgaattctaattgatctcagaaaaaaaaaaaaaaagcacgcactttttatataccagttgtcatgggctttttgcaggcccccagagatcatcacagattgcgtttcccatgggtctcattcctgcctgagacactgcctttctctgggtacctataaacctggagagtgacatggtggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtgagattcgctccttaagtgatgacagtggctggagtttatagagcgcccactgtgcactgggcactgtgcaaagtgccttgtctatgttaactcacctgtccatcacaacacacctgtgaagatactatttgcagcaccagaaactgaggccagagaggctaagtgacttactcacggtcacccctggtcagcggcagaactgggatttgaaccctggccaactccagggttagtacttgtagtctctgctctattgactgcctgagcagctcaggggggtctcattcgctagaggtgagctggatgctttaaatcagggcttcctgcaacgtggggttcagttgtgcatgagatggtgtccggttgtgcacagacgcattaaatgacagaggaatgtttgtttcatttctttttttaatttttatttttttgagatggagtctcactctgtcaccaaggctggagtgcagtggtgcgatctcggctcactacaacctctgcctcctgggttcaagcagttttcctgcctcagcctcctgagtagctgggattacagaaacttgctaccttgcccagctaatttttgtatttttagtagagacagggtttcaccatgttggccaggctggtcttgaactcctgacctcaggtgatccacccaccttggcctcccaaaatgctgggattacaggggtgagcaccgcgtcctgcctgtttttcatttctcatttggtcctaatgattacgtccctgagaaagtcccagttgggtcctaccctgccttctcaacctatcaaccactatcctctctttgtaacaaggagaccgggttttgagctcctgttttattgtttttaaagatcgtctattttgggcaagtgttaataattctccatttatggtggtgatccaaagtttatttttaaaaataaatgtggttttttttgtttttgtttttaaagggaatggaatttttaaagtaggtaaaaaataagcatgcagataaagaaaaacaaaaaaaaaaacatgaaaggtggtagccggggagtggggctggggcactttctcttagatctgcccggatgtgtccagagcttccgaggactgtctgttcctggcttcttccttaacttgtcatcagagtcaggaccgtaacaaggggcagaggtgactctggtgtcctctctcgccttacccttagtgaccctccaggaagccagagaagttaccccaaatcgcaggacatgggaaggaagggccagagatgccaggcccatttaatcctcatttaactccaattttatattcaaggaacatcaaagccagggggcttgttacttgtcaaagttggacccagagtggagccaggcacaacacgcttatcgtttctttgtgtcttttttttttttttttttttttttgagacgaagtcctgctgtgttgcccaggctgtagtgccgtggcgctcaccgcaacctccgcctcccgggttcaagcaatttacctgcctcagcctcccgagtagctgggactacaggcctgcgccaccatgcctagctaatttttgtattttcggtagagatggcgtttcactatgttggccaggctggtctcaaactcctgaccttgtgatctgcctgcctcagcctcccaaagagctggtgctgggattataggcatgagccactgcgcccggccttttttttttttttaatttgttttcttttttttttttctgagacaaggtctgactctgtcacccaggatggagtgcagtggcacaatcatggctaactgcagcctccacctcccggattcaagtgattctcccacctcagccttccaagtagctgtgactacatgtgtgcacccccacgcttgactaatttttttaatttttttgtggagatgaggtttcgccctgtcgcccagactggtcttgagctcctgggctcaagtgactggcccgcctcccaaagtactgggattacagatgtgagccaccacacctggccacacacttgtcatttctgacccccgagcccaccacattccactactcatgagaaagaggttcctgaacgctgcaggctaatttcagggacagcaggcaacttggccgcatgacaaagccaagtggtgaaataaacacattcttaattatgacctgtctcctcacccacatttttcattttccagaatggggacttgaaaactcaaaaggaagcagccagttacacatcagacctgttatctttcacctgttacctttcagctagaccgtagggtcagatgatttttgtttttttttctggtgaggggcagagcctcactgtgtcgctcaggctggagtgcagtggtgtgaccaacgctcactgcagccttaagcttctgggttcaagagctcctcctagctcagcttcctgagtagctgggactataggtgtggaccaccacacctagctaattttaaaattttttgtagagacagggtcttactgtgtttcccaggctggtctcaaactcctgggctcaagtcattgtcctgccttggcctcccaaagtgctggcattataggtgtgagccaccgcacccagtccagatgattttcatgacccaaaattcagcatgaaaagcttgaaatgacaatgagcacagacacgggtaaagatccctggaatttcttgaaaccaagtcaggtggtttaggtgggggctggcctaaagcagattgccctgtctctcatgtcaggcggctagacacatttgtttagccccatgctgggctccacagggaatataggagggaaagaaactccaaccttcacctcctggagcgaactgggcactgggaagatgggtgagatggtattctgtgctcagagtgaaaagagttggaggaggctggcccagttgtggtgttgaggtgacatttggccttggttgccaggcaacatgtcacacgttgcttaaaactcattggtggcttctgctttctgtcagtcttggctaaaagttggaatcctgacccgagtctcccatgccatgtgtggtctgactgcgaccggtttttccagcctcttgttccttgctgccccatgatctcctggctccagccaccagtgccttctctcagttccccagatgcactgtgttccctcctacctcagggcctttgcacatgctggttctgccaccttttttccattttcagctggtttaactcctttttttttttttccccctggaggcaatgtctccctctgtcacccaggctggtgtgcagtaagtttggcttggtgcaacctccacctcctggcttcaagcgacccttgtgcctcagcctacaggcatgtgcccccacgcctgactaatttttgtattttttgtagaggtgagatttcatcatgttggccaggctggtctcggattcctgacctcaggtgatccacttgccgcagcccctcaaagtgctgggattacaggtgtgtgagccacgatgcccagcactctttatttttttttattttttagagacagtctcactctgtcacccacgctggagtgcagtggcgcattctcggctcactgtaacctccgcctactgggttcaagccattctcttgcctcagcctcccgagtagctgagatgacatgtgcctaccaccatgcccagctaatttttgtattttagtaggcaaggggtttcgccatgttagtcaggctggtctcaaactcctgacctcaggtaatccacccgcctcggcctaccgacgtgctgggatcacaggcatgagccactgcacccagccttggtttaactctttaatgtcacttcctcgaagaaaacctcccccaatacctctctagactgcattaggtcaggttgtctgattttatactcacgtggaattgtgcaccgtttacagcccttctctgtgatgacgcatttatctgggatgattttatgggagcctatctcaccacgcgactggaagctccatgcatgagggcagagaccctgagtttgtctcttttttttgagacggagtctcactctgtcgcccaggctggagtgcagtggggcaatcttggctcactgcttctacctctgcctcctgggttcgaggaattctgcctcggccttccaattagctgggattacagatgccgaccacacacccggctaactttatatttttaatagaggcaggattttgccatattggccaggctggtctcgaagtctctacctcagttgatctgcccgcctcagcctcccaaaatgttgggattacaggtgtgagccacggcgcctggccctcgactttgtttactgctgactttgttgaatagctaaaggggaggggtgttctacgtaggagcaaaggcaggcagctgggtggcacagtgctggtgaagcccccgaccttgtggggctggggctggggctgggtgcgtgcatgtgctaagctgccttatctcctgtgatctccaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaaggttggtgccgctgtctcccaccccgcctgatttgggcccctgttgtggctttgtctaattatagaaatggatccttagagtcctcagcgttttgtgggaccccaaaccaagccaaacccagaaaaatggtagctgtcagctagtagacactcagatatttgtagagtgggtgtttgagtgctttgttcatatgggccttggtggtagacgggaggagtgctccagtgtgcccattttacagatgaggacagttgagaacagaggcctctggaagcactgagggttgggaggacccccttgagcatgtttgctttgtcacagtgacagagcttccatgaggtctcatttgcggacttttgcctgctgagtgagggcggaaattggcttatactagtaattcccaattatgggcagtgttgtccctcagggatgtttgacaatatctggagatgcttttggttgtcaaaagattgagaaaccctgctgttggccaggcatggtggctcacacctgtaatcccacactttgggaggctgaagtcaaaggattgcttgaggccagatattcgagaccagcctgggcaacatagtgagaccctatttctagaaaaaatagataaataaaataaactacaggtcacgtggtggtatgcgcttgtggtctcagctacttgggcagctgaggtcacaagattgcttgagcccaggagtttgagcctacagttagacctatgattgcaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaactgaggcccggagaggttgagtcagttgccaaaagtcacacagctaatacatggcagcattggcattgaacaaggcagtctggctcaggagctcacgctgttatccactgtgctacgcagtatgtgagccatgtttgcaaatacacatgtatggtccatatgatatatacacagtaaatggatagtcttgacacatttgagtacttctgtatgccaggcacattgccaggtggggacttcacattccacagtgctccgaggtcagcgtcattgtcccattttacagatgaggaaactgagagattcagtgaccagtaggaggtcccatagctggtaagtggcagagatgggatttggcagcattggctccagagcctgttacttgagcccctgcctattgggtgtcttcccgattaaagaggccgagatggaagcctctctgttcctaggaagttgctgctctggaacacacagtgcgctcctgtggattgtttgagagaagcaccagtgtctcaggatctccaggaggtggctttgggaaaacccagcggtagcagagcacacatggactccttgagtctctcaatccctcccctcccctctccttgccattaggggaaaggactgtggcctacaaattataattgagggaaggtagagaacagagagggtgtggtattacctgaactcacacagcaacaacgtctgttccagagctgtgctgtctggtgcggtagtcacaagacacaggtggctattttaatttcagctgttaaaattaaataaacgttgggcgcagtagctcacgcctgtaaccccaacactttgagaggccaaggcgggtggatcgcttaatccaggggttcaagaccagcctgggcagcatggcaaaaccctgtttctacaaaaaatacaaaaattcgctgggcgtggtggcgcatgtctgtaatccctgctactcaggaggctgaggtgggaggattgcttgagcccaggaggtcgaggctgcagtgagccgtgatcacagccctgtactccatcctgggtgacaggatgagagagaccccatctcaaaagaaaaataaaattaaagatttattcgattagactagacacgtttcaagtgctcagtagccatcatttcagaaaattatctcagcactgttctaaaacagcgatccctagcctttttggcaccagggactggtttcatggaaatggtgggtggtgatttcgggatgaaactgttccaccttagatcatcaggcattagttagattatcagaagaagcgcacagtctaggtcccttgcatgcacggttcacaatagggttcgcactgctaggaggatctaatgccaccactgagctcacaggaggcagagctcaggcgctgatgctcaggaggtgaccaccactcacctcctgctgtggggcctggttcctaaccggtcatgagctgctgccaatctgtggccccggggttggggacccctggtctagaagaatatggcatggggattaagagcaggctgtctggattaaaatcccagttctgcttctgctaggcacagtatactaagggcaaaggcgttcacctatctggacttcagttttcttatctgtaagttgggtagtaatagaagttattcagagtcatcataaaaatcagttacatgtaaaacccagcacagtgcttagcacataggaagtaccctctgaataatagctgccattatcatcatcattattattactatttttttttttttgagacggagtctcattctgtcgcccatgttggagtggagtggacgcagtcttggctcactgcaacctccacctcccggattcaagcaattcccttgcctcagcctcccgagtagctgggattacaggcgccaaccaccacgcctggctaatttttgtatttttaggagagacggagtttcactgtgttggccaggctggtctcgatctcctgacctcaagtgatccacccacctcggcctcccaaagtgctgggattacaggtgtgagccaccatgcctggttcatcattattattattattagaagttgggagtccaggcctgcctcgtccacatggccactcctccctgcagtgcctggtcagctccctctctgcattgtggagttttaactccgagtgtctgcagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccaggtaaggggtgaggtcttagtgttcgggacaagccctactgtgcattatataccagtgttacctaaagccttgttttatcttaccatgtccccagtgtggtgcttttgaagcatgtagatttgtttttgtcagtttcgaatacctaaattgtttttttgctcacaataacaaaatgcactttttttgtggaatgcagttttttcctaagttttacttttccacctgtcaattcaaaaaggaaacaaaacctatcactataaagacaacttcattattaaaatttctttttttttcttgagacagagtctcgctctgtcacccaggctggagtgcagtggcacaatcttggcttactgcaacctccacctcccagttcaagtgattcccctgcctcagcctcctgagttaacaggtgcgcaccaccacggccggctaatttttgtatttttagtagagacagggtttcaccagtgttggccaggctggtctcaaactcctgagctcaggtgatccacccacctcgacctccccaagtgttgggattacagatgtgagccactgcgtccagcctaaaatttcttcaagtataaaattctttagttcttaagcctcctgcaggaggcaggaactaaacaaaaaacatgactaatagcagcctaaataagatagacgttttctttttctctgtcataatagaaatttagaggtaggctgttcagggctggtatggcagcttcatgagtttaatatcccagatacctgcttttatttaaaaatttaaaaaatcttaccatatttatacaagcctttcattctttctttctttcttttttttttttaatttgacatggagtctcgctctgtcgcccaggctggagtgcagtggcgcgatctcggctcactgcaagctccacctctcgggttcacaccattctcctgcctcagcctcccgagtagctgggactacaggcgcccgccactacgcccagctaattttttttgtattttcagtagagacaaggtttcaccatgttagccaggatggtctcaatctcctgacctcgtgattcgcctgcctcagcctcccaaagtgctgggattacaggcgtgagccactgcgcccggcccctttcattcttaagttggcctcatggtccaaggtggctgctggagctccagccattatatctatatttcagtcagtgagatcaaggaagggaagtagggcaagggagcatatgggtgctgaatcagcactactcccttatctgcaggcacacattctaagactcccccaatggatgccttaaactgcagatagtattgaatcctacatatcctgtttttttctgtacatacatacctatgataaagtttaatttataaatttggcataatagattaatagcagtaatttataataataaaatagaacaattataacaatatgccagtatcactacttctccacattagaggcgttatttttattacttttttttttgagacagagtttagctgtgtccttcaggctggagtgcagtgatggaatctcggctcactgcaacatctgcctcccgggttcaagtgattctcttgcctcagcctcccaagtagctgggattacaggcatgcgccacacccagctagtttttgtatttttagtagagacgaggtttcaccatgttggccaggctagtctcaaactcctgacgtcaagtgatccgcccgcctcagcctgccaaagtgctgggattacaggcattgacccactgagcccagccaggggcattattgagtaaattcggattacttacccataagcactgcagtacaatggccgtcagtctgataaccgatatggctattaagtgactaaactgacagggagggtctgcagcatggacctgctggacaaagggatgattcacaccgcggatgggactgggggggatttcatcacactactcagaagggtgcacaatttaaaacttacacattatttttggaccacagttgaccatggataaccgaaaccatgtgtgttagtttgtcctcatactgctatgaagaaatacccaatactgggtaatttattaaggaaagaggtttaattgactcacagttccgcatggctgaggaggccatggcagaaggagaagcaaacatgtccttcttcacatggcagtaggaagaagaatgagagcaccacgaagtcggggagcccccttataaaaccatcagatcttgtgagaactaactcactatcatgagggttgggggaaactgcccccacgattcagttatctccacctggtccctcccatgacacatggggattaagggaactacaattcaagatgaaatttgggtggggacacagccaaaccatataaccacggaaagtgcaaccttggattagagggacacctgtacatctaattgtccagaacttagtcatgggaccacctctattcacaagggaccctggaaagtgccgtgttttagctgggcacattgcacttcccagcaaaaactttcagttgggcctaggcacggtggctcacgcctgtaaccctacccctttgggaggccgaggcgcgtgtatcacctgaagtcaggagttcgagagcagcctgaccaatatggtgaaaccccacctctactaaaaatacaaaaattagccaggtgtggtggcatgtgcctatagtcccagctgctctgaaggctgagacaggagaattgcttgaacctgggaggtggaggttgcagtgagccaagattgcatcactgcaatccagcctgggcaacagagtgatactctgtctaaaaaaaaacagagaagtttctgttgggaaaggagaaattgtgtaggcagtcagtcgtctctgctgcatcccttctgcagaaacggttatatgttctttgttctttgaacacatgtggtttcttaggatatcgcaggatagataatgttttcaattgacaggtggagcatcttgctaagtgggagagctgagagtgcaacctcaagtctgtccaattccaaaactgctgttaccgctaaaggattaaccgcagcacaattgccagtagggatgggttgtttagatgggagcattccagctgcaaagcaaaacaagagtaagaaaccatgaggctcaccatatctcaaaccacgctgcacagctgttcaggtggcatccagggggccttggttcaatcatgtggcccctgcgccccaccacactgtggcccaatgattgatgagaacgaacagtgatggaatcagagagagtaggtccagttcctggagtctcgttatatcctcttgaaattggtgccagcttttttttttttttttttttcccctgcatttaccaaatatgttatctgtgttcatacgcaagctggaaaatttcctgaaagacccaaaaagaacaaaacaggccaaatgcagtgttgaaggcaacttaaatgtctgccaatagcaggaccttgggtacaccgtggagcaatgtggctttgagcagggataattagaagacgcagctgttggagcaccaaggatttttatttttcaacaacaaaggaaatgattttagcaaaggaccaagttctaggtgcactgtcgttatcaccgagatgaaatgcataatgtgtgtgggcaggactggaagggaggcagatacatgaaaacatcgtctttttaagggttgagattatagaatagttaattttttaatggcttttggctaaatttacatttatcctctcactaggcagtctcattcctaagtgtatattaaaaaaaaaaaaaaaaaaaaaagagcaaaggcagtgcttagaatgttctcagcatcttgattcataatcgcccaaactggaaacagctcaaatgtccattaacaggaccgtggagaaataaattgtgatataattatacaatttatggttgagtagtaaaaaggaatgaaatgctaatacacaacaatttgggtttatctcagagatgttatagtgatcaaaagaagccagacgaaaaagagtaggtactgtgagatttcatttatatgaagttcggtcgggtgcagtggctcatgcctttaatcccagccctttgggaggcctagacaggaggattgcttgggcccaggagttcgagaccagcctgagcaacatgggaaaacctggtctctacagaaaatacaaaaattagctgggtgtggtggcgtgaacctgtagtcccacctgcttgggaggctgagatggaagggtcacttgagcctcggaggcggaggttgcagtgagctgacattgtgccagtgcacttcagccttggtgacagggcgagttgtctgaaaaaaacatcagatcggcagggcaggtggatcacctgaggtcaggagtttgagaccagcctggccaacatggtgaaaccccatctctactaaaaatagaaaaattagccaggcacggtggtgggcgcctgcaattccagctacttaggaggctaaggcaggagaattgcttgaacctgggaggcagaggttgcaatgagccaagattgtgccactgcactccagccagggtgacagagcgagactgtcttaaaaaataaaataagatcattcctgaacaaatattcatctcaggttagatttttccagtaagtaaggttcagaggcagtggcaagtggaggaaagtgaacaggtaacacacttgagagcgatttgcatctggattgttcagaaagcaagctggtaagagaggaaggagatgtggtccagggtaagatggggcagatcacctgggccttcagccatgcagaggggtctggatttcatgggaggcggtgggaacagctggagaagaaattatatctgatccacattccaggaattggcagaacagctattctgagactgcgtggggttgtgcggtacctgggttcacttacatagcttctggggccccagaagactctccatctgtgggttgcaattaacgcccgtgccgccacccaggaagaagctgccaaccacagaggccttgtaaaagccacctgctgctattgatgctttttgttggactctgccccaaagcagcccagtacacctggcccagggcaggatgcagggaggccgagttcctagcaaccctttgttagttttcccagctctcctgtcgataagcaattgtaggcaccttgtggaatcaggaaccccgggctcaccagttccttttgcgtagatgagaaaaacctaggctaggagagcgcagtgtcctcacatggctggtgcagcctctgatccacagctccacaaagcttgcagaaggtggttggcttttgttctgaatctaacaagacttatcgggaggctcttggtgcctggcactggctgaatgcccaggttgggggaggcagagcagatgaagcatctgcccgcgagggtgggtggagctgcttgtgaaacgtatcatcgtagcccgggagctgggacactgaagcccggagaaggtgctcatggaggatgggaagggcttcccgaggaagtgacatctgtgctcccatctgctgggtgatgaggaatggcctggacgggatgggcatggtgggtggaggcaggcggcctgtgtgcagggaaggaaggggagagttacaggatgagatgagttgagggaagaagcatggttggcaactctaacagcgctgggaggccatcggaggggggtgacgagattgaccctatcctcatgggcatctcagctgggctgagtgtgctggaaccggccattgcatggacacagtcactcctgaggggatgtgatcaacaggcggaattctgtcacttaatgataacaatagtcaccagctaactgaatgcttactgttaggtcaaactatatgaaactgctaatacttatttcttatctacagaaacagctatttcctgtggttcaacctagtattaccaggcactgtgcttagtgacatcatgcatatctatatgatttatgaaataatgtgtccacgcaaatacacatcacatgtaagactgtaactcttacatgtcaccctcacaatgaccccgtgaagcaagctttgttttgtttcgtttgttttcttaataatattttatttttgtagagatggcattttgccatgtgcctgggctggtctcagactcctggcctcaagtgatctcccgcctctgcctcctgaagtgcgggtattacaagcatgagccaccccacctggccgagcaagccttgttgttcccattttacagataaggaaactgaggcttagagaagtaaagtgttagtcgtgtttatattgccagtcagtagttgagtcaggatttgaactgaggtctcgttgacctcaaagcctatgctgaaaaccacactgctggttccagaaaaccctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtgggcatggtgggcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctgttcccgtctgggggtgatcatgcacccctgggtgatgtgtgtcagaagcaatttactaatactaagctaaaccatatgagattgtcatcttgtgggccagatgtcatggctcacgcctgtaatcccagtactttgggaggctgaggcaggaggatccattagattccaggccagcctgggcaacatagcaagacccccatctctcttaaaaaaaaaaaaaaaaaaaaaaagtagcccatcatggtggtgtgtgcctgtagtcctagcttctcgagaggctgaggctggaggatcgtttcagcccaggagttcaaagttgcattgagctatgattacaccactgcactccagcctgggtgacagagtgagaccctgtctctggaaaaacaaaaaaaggagatgggggtgggagattgacatcttgtggatcacagataatagcatcaatccaaaagaggcagaagtttgctaattatttgctgaatttagagaagtgtccctctcacccatttgcatccttatagacttttctgaaaaagtgacagcaccccagaggtgtcccataaccattagcccgtcttacacactctaatcccatagcgtaagtctgggtgggctaaccctgaatgattacagaccttgacttcccttcagaatttttagggagtttgtcacaatctggctgtgtctgtcggagtagtgaggatcagtcacttggttcataagggctgcaatggagaaaagatcaacaccccatcttcctagaatgctttatattttagaacattaaaataatagttctagtgctatatgatatcatacgaagcctagctttaaacaaataagatggccaggcgcggtggctcacatctgtaatcccagcactttgggatgccaaagtgggtggatcacctgaggtcaggagttcaagaccagcctggtcaacatggcaaaatcccatctatattaaaaatacaaaaaaattagccgggcatgatggtgggtgcctgtacttgggaggctgaggcaggagaatcacttgaacccaagaggcagaggttgcagtgagccaagaccgcaccattgcactccagcctgggcaacgagagcgaaactctatctgaagaaataatagaagagaagagaagaataaaataaaaagtaaaataaaatagttctgatggtacatgataccatactaaacctagctttaaacaaataagatgaccaggcacattggttgacacctgtaatctcagcactttgggtggccaaggcaggcgggtcacttgagcccagcagttcgagaccagcctgggcactctagggagaccctgtctctaaaaacaaaacaaaaaaccaaaaatttgccaggtgtggtggcatgggcctgtagtcgcagctactcaggctgaggcaggaggatcactggaacttggaaggttgaggcggcagtgagctgtgatcatgtcatccacactccagcctggatggcagagtaagaccccatctcaaaaaaacaaaatgacagaaaacatgatttctgtttctattttaaagggtaaaatagtatattttaacactttgaaatgaagagtctgggcttgggaacgttacaatgatgtttactcgtactagttacgcactcccctcccagatctgtctcgtaacaagagactgttattttctacttgtttttagccaaaaggccgagaaacgatggttattttaaatccctagtgtctcttacagttgatgtcttcttagtatttaggaatttccaggacatctttttgttgttgttaatgcactgtgtgtgtgtgtgtgtgtgtgtgtgtgtgtgtgattataggagtgacccactacgcccggctgtgtgtgtgtgtgtgtgtgtgtgtgtgtgtgtatgtgtgtgtgtgtgattataggagtgacccactacgcccggcctatgtgtatgtattttaaaggcttcaatgagaaaaaagttggttcttaaaaaggcaagcttcagattccagggaagattgcctctggagagctctgttttaatccatgggtttgccagattaatgaggatttactggcctcgtgccttcggccctccctaccctgcgcccattgtgcatgttttgaaaaagcagtgccaggaaggactctctctggaattactgcggagttacttgagttagcaaagaatccccttcctcccccaagagctgtaagccaagtctctgtagagctgactccatgcctgtttgtctgcctgtgtgtcttggcgcaggtggctggccgtgcggctggagtgtgtgggcaactgcatcgttctgtttgctgccctgtttgcggtgatctccaggcacagcctcagtgctggcttggtgggcctctcagtgtcttactcattgcaggtaagaggggatgctcttggctggattattaaagtctgttaatgggggagccagttgtccttggctttggattccagctccaacaggaatgggggagaggaacttgagaggtacggagtttgaggagcaggtacagtgccacagtgcctggtgaccaactagagcaggagacggatttgacatgtggccaggattttccccatcagtcacacagattccttagtggcccaagaggatacttccaggtacgaggggaatgcttttaaagctatgaatttccctctaagaactgctttagctgcatctcacaaatgatgatacattgtgttttcatattgtcacctggctaaaaatattttccagtttcttattatgtggcccatgagttattttggaaatgtgtgtgcttaggagatggcaatgtggcaggcctgggtgatggctatacctggggttgctaatttcggtacctttcttacctgaatgtttcataactcataaccttttatttttatttatttattttttttggagacggaatctcactctgtcacccaggctggaatgcagtggtgggatctcggctcactgcaacctctgcctcctgggttcaagtgattcttctgcctcagcctcccaaatagctgggtttacaggtgtgcgtcaccatgcctggctaatttttatatttttagtagtgactgatggggtttcgccacatcggccaggctggtctcaaacccctgacctcaggtgatctgaccgcctcagcctcccataattcatacttgttgaaaataatttgtttcctattatctcagtggaaaaaaagaaaaaggaaagtcaagtacgcccgcttactctagaaatgccacgtgactcttccactcacaggtcaccacgtacttgaactggctggttcggatgtcatctgaaatggaaaccaacatcgtggccgtggagaggctcaaggagtattcagagactgagaaggaggtaggcaagggcccctggctggacctcttggtctttggtgtagctttaccccaaggagatctctggaccctatcctgtgcacctctgcctctgagctggatacctcaccaggtagaagtgcatcttaacgcttgtccagtctttttgcagcacttatttagagcccggttttagggtgaaaatagtttaccggctttacccaagatctggggtatccatatacgagactgtgggatgctgtcagggcattcagaaggtattcacattgtgaagaagtttccccctctatttctctttcataacttctgatggtatcacagagaaagtcttagtctggggctagcaggtctttaacaccttagcaattgagatgatctcccttcaacagacagataaacagcagccctcacacttggagtcttcaacaggacggattctgtctatcagaaataaccttctgttatttgttatgaatttggtttttttgtgtgtgtgatggagtctcactgtcacccaggctggagtgcagtggcacaatctcggctcactgcaacctcctcctcccaggttcaagtaattctcctgcctcagcctcccaaatagttgggattacaggtgcctgtcatcatgcctggctaatttttgtatttttagtagagatgggggtttcactaagttggccagtctggtctcaaactcttgacctcaggtgatccgcctgcctcagcctcccaaagtgctgggattacaggcgtgagccactgcgcctggcctgttatgtatttgtataggggactcctgttacggaaaataatactacttttccttttgtgattgtaataaattttcctcttaagtaagttgagaaattaagtctaagtgacttgattaagcatattaaaacaacaagagaatgagtacatgcatactacacgaatgatgtagctgggaactgaccaaagtttgggaaaccctgccgttattgaaccccagtcccctttttatagatggagaaaaagggaacctggggagggacaacagctgatccaaggtcccacgtggcttggtagaacagctgggactaggacccgtgcctccagtctttgatgttgcgttgcccttaataactgccttcttaggccctgaacagcagcacaagtaggaacagcagtgataatagataatcacaataatgcctggcgacacccccaccctacattaatgataacagggacacacatagtgccttgtagaatgtcaggcccagacttaaacgtttaatatagagtaatgcactcagtctttaccccgctctatgactgatttttgagacacggtctcactcttgcccgggttggagtgtagtgcgatctcattcgctgcctcccaggctcaagtgattctcctacctctgcctcctgagtgtctgggaccacgggcatatgccatcacaccggactgatttttgtatttttagtagagacgggattttgcccagactcatcttgatctcctgagctctagtgatctgcctgccttggcctcccaaagtgctgggattacaagcgggagccaccatgcccagcccagccctataatttagatgctactattacccccattttacaggtgaggaaactgagacaaaaagctgaagttacttgcccaagatcacatggctggtaaatggcagacctaggcgttgagcctgtgcctcctcagagaccctatccagtgccatgggagtcatgctacccggcctcctgaggagagatgccccttgggagtgagaccaaggcctctgtaaggtctgtcctcctgaggaattcacagaggtgacctcggcccactcctttaacattctgactgggtgaaccaggtcccatgtcacgggtgagcattgtaagaatggcgtgagtgcccccgtgaggaaccaagggtgtattacaccggcggcttccaacttgacactgaatttaattcacttacaaggtatttcattaggttttttttttttttttttttagatggaatttggctttttttttgcccaggctggaatgcagtggcacgatctcagctcactgcaacctccacctcctgggttcaagtgattctcctgcctcagcctcccaattagctgggattacaagtacccaccaccccgcccagctaacttatttcattagtttttataatagcctcattgacatgtgaatttcacatgccatggaattcacccagttaaagcgttcagttagattgaattcagttttttttttgtttgtttgagacttaagtctcgctccagcctggagtgcagtggcatgatctcagctcactgcaacctccttctcctgggttcaagcgattcccagcctcctgagtagctgggattacaggcgatttttgtatttttagtagagaagggatttcaccatgttggcccggctggtctcgaactcctgacctcgtgatccacccgcctcagcctcccaaagtgctgggatcacaggtgtgagccaccacacccggcctgagttcagtttttaaaagcattttacttttgactgacttttatatttttagaaggatcgtgtttgacaaacccaagagaaagtaattgtcctcattagtcctaccactattctgtatttgcatgtatttttatatatagatagaaagttccacatacttctctccattccgctcactgtgttgttatagcatctccccttcaattatgtacataaattataaaatagagatacacttgttgttttaaaaaagaaaaaatcaatacagggctggacacagtggcccacgcctgcaatcccagcactttgagaggccaaggtgggtggatcacttgaagccaggagttcgagaccagcctggccaacggtgaatcccgtctctactaaaaatacaaaaattagttggcatggtggcaggtgcctataattccagctacttgggaggctgaggtgggaggatcgctggaacccgggaggtggaggttgcagtgagctgaagaaacatcactgcactccagcctgggtgacagagtgagactctgtctcgaaaaacaaaaaaacaaagaagtttatggtggagaaagacagtttgttcctgttcgccccgttcctctcctctccagagagaggccccattagcattcgggtgaatttcccccaaaactttcccgtgtggattcccacataccccaacacttttgtttgcttgtttctttttcttttaacgtaagtggaatctacctgttatcctgtgaaaccttttctttaaccatgaggcacctttgcatctgtgtatagtaacagtcactgcctctaagggctgctgtgaggctcagatgagatcatgggtctcaagtgctgagcagagcaacttgccttagttgcattgtaagcgctcaataataacatttattttttggccaggcgcggtggctcacgcctgtaatcccagcactttgggaggccaaggcagatggatcacttgagcccaggagtttgagacgatcctgggcaacatggtgagacatcgtctctacaaaataaaaaataatactttttgttgttggcggtggtggtggggtttttttttgtttttttttttttgagacagaggagtcttgctgtgtcacccagactggagtgtagtggttttatcttggctcactgcaacctctgcctcccagattctagtgatcgtcgtgtctcaacctcccaagtagctgagattacaggctcccaccatcaggcccagctaatttttgtatttttagtagagccagggtttcaccatgttggtcaggctggtctcaaactcctgacctcaagtgttctgcccacctcggcctccctaagtgctgggattacaggtgtgagccactgcgccggcaacgctgtgattttatagcacgtccacaaaagggctgcatgtcttgcctaaaagttgcccggcgttttcttgttatgtgccgtctgcagtgcccctgagcttggccatgtgctctgcagcctggttcagcacctgtgtgtgccctggacggggaggtgcattccccgaggctaaaaccagtgaacctggcccaggccatatccagctgtgggcctcaggaaatgctgaactgaactacttttcaaaaggagggttgtgtgtccctgggcaagttaccgcccctctctgtgtctcagtctccttgtgtgtaaactggggataatgaaaggaccctcccacatggggttgctgtgaggattggatgagacactgcgatacagatgctgcttttatccttgccttcctgccggggtgggcagccagggtaactcacttttattgtcgtgtctgtccagagaagaccactcatttcattgactccatttataaatatttatttaaatttttttttatcaaaaagtaagttttattggcatctaaaaacaaaattcacccaacactgaaacatacttcaatatttatgttattgttttcttgtttcttttttactcactgcagtgtgaggaacaaatcacatttactttggagaaacagagaccatagtgtagattttacaaaatcactttttaaactctctgtattgcgctcctcaaatacctagagccagtctgtgcataacatggcacactgttgtctaaaccgtaaaattttgcatcagcctaaagatatggataagatatacctccacttgctcttttgaaatacatctattaccttatccagcctaatgatagttacctaaaaaattctttgttccgtaggaagtctctgacaagctgttattcatttccttgacgttaaaagaatctgggggcaacatttatattttatcagaaaaactttttaaaagtttacctatcatgttcatattgagaacaatgtctgtggcgggcatggtggctcacgcctgtaatcccagcactttgggaggtagaggtgggtggatcatgaggtcaggagttagagaccagcctggccaacatggtgaaaccacatctctactaaaaatacaaaaattagctgggtgtggtggcgggtgtctgtaatcccagctactcaggaggctgaggcaggagagtcgcttgaacctgggaggcaggggttgcagtgagctgagatcatgccattgcactccagcctgggcgacagagtgagactccatctcaaaaaaaaaagaacaatgtctatacaaatcagttgtacaattattttaaaagaatggtgagcatgaacgtcacgttaattctggcagacaaaaatgaacaactatggtccattgagccattatctgttacacagagatgacagctttacagaaggtatctctgacctactgagggatgatcatgtcctctcagtttctgtgccttctaccactagttcactttctatatcagcagctgtgtcactcttcttgtttatgttcataaatgtgtgttgaacacctactatgtgctctgagccctgggatacagcagtgaacaattagagcctgtcctcattgagtggatggtgcagtgggtgtgggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggaggccaccttgggcagcagagtgagtgagaggggaggtcaggggagtcacagctttaccagatggactggaaattccttactctctcccttcactgcgatcgaaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtgggtacacatcgccccattccctcacccattcccagtcgggcacagggtgccatcgggcaggtgaacctagctgcagcgtctccccagtcactcacggctccacacctttgcttgaatggctttttggggggctgggagtggactgtggcagtaaaagctgttcagagcgcatacagcttgcagaagtgaaggcttttaggtgaactgacagcctgaagaccaaatgagccccacagatttgttttggaagattttttgttgttgttgttgagagagggtcttgctctgttacccaggctagagtgcagtggtgtgatctcagcccactgcagcggcagcctcccaagtggggggactacacatggttgggagtgcaggtgtgtgccactgcacctggctaatttttgtattttttgtagagatgggggtcctactatgttgtccaggctgatctggaactcttgagctcaaccggtctgcccgcctcagcttcccaaagtgctgggattacaggaatcagccaccattcctggcccctggaagaagttctttttttgttttttggttggttgtttttttttttttttttttttttttttttgagatggagtcttactctgttgccaaggccagagtgcaggggcccgatctcagctcactgcaacttctgcctcctgggttcaagtgattctcctgccttagcctcccgagtagctgggactacaggcatgcgccaccatgcctagctaatttttgtgttattagtagagatggggttttgccatgttggccagggtggtcttgaactcctgacctcaactgatccacccgcctcagcctccccaagtgctgggattacaggtgtgagccactgcacctggcctggaagaaatttgaataagttgcaaatactgaaaaatctggaagacttaatataaaaatttattttctgctttttttggaagatcagaacatctggcaacatcaggtcaatcctcccccgcctggctctttctagtcaacctgtgagcctcctggttcaccccagtccctccctgtcccattcattgcctagttggcccctccaaaacattagaatttgtgatctctagaataaggtgtcaccatcccttctagggggatggctcaagggaagtgagaaattgtcagaattttggaaccttctcttggttccgagctgttcttggaagaggttccttgacctgagtgatacccttagactttcctctggaattggtctgacagtcttcctggccatttgctgggggacaaggctgctttcacctctgaacatatggacttattgaactgttcctacgtacctcccacaaagctcagaacattctgttcccagcagataatttctctctgagttacagagaagagcagagtgggtgatgttcttgctgtctttttttgtttttgtttttgtttttgtttttgttttgttttgttttgttttgagacagcctctcactctgtcacccaggctggagtccagtggtgctatttcggctcactgcaacctccgtcccctgggttcaagtgattctcctgcctccgtctcccgagtatctgggactacaggtgcatgccaccacgcccagctaatttttgtagttttagtagagatggggttttaccatgttggccaggctggtctcgaactcctgaccttctctgatccaccttcctcggcctcccaaagtgctgggactacaggcatgagccaccgtgccccagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtgtgaaaaacagtggggaaatgaggaaatgcctgattattacttaatagtttcttgagtctaaacaaatagggctttgttggaaattccttctgcctcttctgtatctcttttgaggtctctagtaacttataaaaagccgagtcattccttttgggagcctggcaaagggaagagagtccttcttgaccttcggccgaaacacccttaaaggagtgtctctgggcagcgcgcaagggagagggctgtcgagttgggttgaccagatgactgatgcctgaggtggggccgagatgagggcactttggggcagggacaagtccggatgccagcattcccaccacacctgggcccttctgtcctgcaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggtggggtctgggtgtggcccagggggtgagccagagctggcaagccctatgattgcactgacagtggtgtatgtatatttttggggcaaacatacatttggccctacttcatcgttcttttttttttttttttttttttttttcctgaaacagggtctcgctctgttgcccagagtggagtgcgctggcgcaatctcagctcactgcaacctccgtctcccaggctcaagcgattctcccaccccagcctcctgagtagctgggactacaggcacatgccaccacacccagctaaatttgttttgtacttttttgtggagatggggttccactgtgttgcccaggctgcccttgaactcctgggctcaagcaatccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggtagtttcagagcatctagaaaaatccaaaaagacaccgtcttctctctctgctgccagagtcagactgagcatctctaacccttccaagagctagacaagaaataagactttttaattttcgattcacggggtgcacctgcaggcttgttacgtgggtatattgtgtgatgctgatgcttcggcttctatggatctcatcacccaactattgaacagagtacccgagagagagtagtttctcaaccattaccctcctccatctgtccccacttatggaggctccagtgtctatcatttccatctttacaaccatgagtacccagagtttagctccctcttacaagtgagaacacacagtatttggtgagaaataaggattttctttttctttctcttttcttttttttctttttttaactgagacggagtctcactctgtcacccagtgcagtggcacgatctcagcttactgcaacctgcacctcctgggttcaagcgattcttctgcctcagcttcccaagtagctgggattataggcacgcaccaccatgcgtggctagtttttgtatttttagtagaaacggggtttcaccatgttacccaggctggtctcaaactcctgacctcgagtgatctgcctgcctcggcctcccatagtgctgggattacaggggtgagccaacatgcttggctgaaataaggattttctagaccaatccccgcaggtggattccttaatatgttgccttttagtgtaatcttccctaaagtgtcttagaagattctcttctgtggttggatgacgggagaatccacgggactttactgttaggaatcacctgtgctgcgtctcatttctggaggttctcaacccacttgcatattgaaggctccaggaagttgtatggaaaggaaatctgttgtattctgccaaactcagactttccagacttttttttttttttccattattaaggcaattttttttttggagatagagtcttgctctggagtgcagtggcacaatcttggctcactgcaacttccgtctcccgggttcaagtgattctcctgcctcagtctcctgagtagctgggactacaggtatgcaccaccatgcccagctaatttttgtatttttactagagacagggtgttgccatgttggccaggctggtctcgaactcctgaccttaagtgatccactcgcctcggcctgccaaagtgctgggattacaggcgtgaaccaccgtacctggcctttttctccattattaacatctccagaaatagtgattccaaggagctctgataccccaccttcaacagtcctggccagaagtccttaggtcgcctccatccatgtcagcgtgacacaggtgtcacatgccgtccactctcttctctctgaacaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcaggtaggcgggggtgaacaaggagacaccgggtaaggtgtcctaggcgccatctcggtaggggtgtttgaagattctgtccagatctgtgtcacctggatttgagtcccagatgaccatttgtcccttcacctcttggagcctcagtttctgtatctgtaaaacgggtctcaatccaggctctttgtaccatgaggtagaataaccaggatgaccagtacatttccttttatacacaccagctccattcagttgatagtggctgtcagttgttaagctatggaaagtcttctgtaccagttggtcactagcactgctctgagcccccaggtccccatgcactaccccagctgtcttggtctctaccaggatcctggagctctgtccatgacccagcaactaaagcattaatgcctggcacaccagcggaacctctggggtcctgctttggtggtgtttgttagtgcctggttctggttctgttatccgtctccatgacaaccaaccataaagcctcaggcatgttcaaccataaagcaacgatcattgctgccatacgagggcagtcagccaggtggctctgctgatctcggctgggctcacatgcatgtctgggagtcagctggctgttggctgatctcggggtcagctggcttttggcctcaggtggggcaagaagggtatgttccgtgcatccctcattctccagcagaccagcttgggcatgttgtcatggcgatggcaggggcacaagagcgtgcaagcccctattgcatctaacagtattcttttggctgtccttacttttgctggtgtcccattggccaaagcaaggaacatgtctgattccagagccacctctcatggccccacagttggataagggatgcatgggtatgaggccttttttttttttttttttttttttttttgagacggagggtctcactctatcacccaggctggagtgcagtggcgcaatctcatctgcaacctccgcccccaggctcaagcaattgttctgcctctgcctcctaagtagctgggatgacaggtgcctgtcaccatgcccagttaaattttgcatttttagtagagatggggtatcaccacattgtccaggctagtctcaaactcctggcctcaagcgatccacccgccttagcctcacaaggtgctgggatactaggtgtgagccactgtgcccggctcttattttttttttattttattttttttaagagacagtgtctcactctgttgcctaggctggagtacagtggattgatctcggactctaactcctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgctgtgcccagtggtaccaggtatttctaatatcatctagtcattcattcacgtcagcgcacctgcggtgttcccagacactggggactctgtaggctgctgtcagacaaagtccctgcctccaggaccaagtagcttattagatggaggagacaaaaaatatacagagcaataaaccaacaggattccagagggcagcaggtgctgggaaggacgcttgccaaggagacgggatagcgagtgctgggcagggccactgtttccattgaacactgcaggcccagtgcgtggggcccacaaaaaggttttattttttttaaaaaatcagaagcaggccaggtgcggtggctcacggctgtaatcccagcactttgggaggccgaggcaggcagatcacctgaggtcgatagtttgagaccagcttggccaacacggtgagaccctgtcaccattaaaaatacaaaaagtagccaagtgtggtggtgcgtgcccataatcccaggtacttgggaggctgaggaaggagaattgcttgaacctgggaggtggaggttgcagtgagctgagattgtgccactgcagtccagcctgggcaacagagtgagactccatctcaaaaaaaaaaaaaaaaaaaaaaagaatataatccaacctggattttatttatactaacacagtcataaaatagaatttctagcattttgtgtggagaaagccacctccgtaggcatcagtgccggggaccacaaaagtcagaatgctgccatagtgccagggtcctggggggttttgagttttgtgtgggtcatctctgaagaggtgacattttagctgagacctgaacaatgaaaaggagtcagccttgagaagatctgggacagcgatctgcaaccttgttcttaagggccggggtagtttcagctttgtgggccacatggcctctcagccacttgactccagtgttgccgtgtgaaagcagtcatagatagtgcacgaatgaatgagcatggctatgttccaataaaactttattcataaaaacaggcaaggggtcagatttggcctgcaggccacagtttgccaaccttggatctaaaggaagaacattctaggcagccggtacagccgaatgtaaaaatgaatgcgcttaatgaatttgaaggctagcatgaggaggccatgtacctagaggttggaattgagtggacaggggcaggagattaggccagaaaggtaggcaggggctggatcttagagcaccatgtaaccacggtgagaagcttggaacttactctaagagccctataaagccattggaaggttttaagcagggaagtgacatgagtttctattttattttatatatttttgagacagggtctcaccctgtcgcccaggctggagtgcagtggtgggatcacagctcactgcggcctcaagtgatcctcctgcctcagccttccaaagtgctgggattataggcgtgagtctctgcacccagctgacatgatgtttctagttcactgagtaccacctactaagtggcagatgctgagttggtgcttttgaaatataggacatagaaatgaggacagaagtgggcagtgtcaaatcttacaggacctaaaatattaggggtcagccaactatggcccacaggccacagatctggccccctgcgtgtttttatgaataaagttttattggcacgcagccacatctgttcattttcctgttgtctctggcagctttcacactataaatacagcagagatgcgtagttgtaacagaaagcatatggcctgcagagcctcaagtatttactatctggcctttttcagaaaaatgttgccaatcgttattgtagactgtggtaagatctttttattttactctgaatgtaatggaacagtgaatgtgaacagtcaacactgttaataccattcacaccatgattgatgtggggtagatattaaggagctggcctcatgggaatctgacattgactagaaatagggattgagggtgagcaaccagctggaaggtactgcaccagtcctagcaaaaagtgttaggggcctgacccgaagcagtgacttgcccaggtcagttgtcccaggggcacgaggtgctcacccctccccttcccctcatgtctgtatcccctctccctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatgtgtgcggtactcgtagcctcggtcaggttctaagacacaggcgaggcagaaatcacatgtggccagaacgatccttgaaaatcctgccctccccctgcccttttttttttttttttttttgctagaggcacggtctcactctgttgcccaggctggtgtgcagtggcacgatcatagctcactgcagcctcaaactcctgggcttacgcaatcttcctgcctcagcctcctgggtagctgggactacaggcatgtgcccagctaatttttaaaaatttttatagagtcagggtcttgctatgttacccaggttgttcttaaactcctgggctctggggatcctcctgcctgagcctcccaaagtgctggggttcaggcacctggcctgaaaatccctttatgttagtccagagaggcgaggctgcgctgcagtaacaaattcgccgtaaaatcttcggaaatgatcacaaggctttatttcttgctcacgcagttcttggtgagggtcagctgcctctccagggtaggtgacttccctgtgacaagtgatccaggctgtcctggttttgtgacatggcctcccaagggttggcctccaggtccccacagtgggagaagggagagtggacgactctcacccactcttctgtgtctgaaaccggaactgacgcagttaatcccactcacagcccattggccaaaatgagtcacatggccccaacccaaccactgcgggagctgggaaatggagcggtgcctgtggaagagaaggatttctccctttcctaactgatgtggttctggagttttggatagcggagtagtcagactagtgtgttcggtttctaacttcgaactgggtgagtctgggcagtaaggaatgtctgtatttggggagcacaccatttctgccacacctaaaaccatgcaccaagtacatgtgcagatagaacgttctagcactgccattgttccctcaagctttcctgtcccctgattgaaattgttggcttgcactagggactgtggtgtacaaaggtgctcagggaagagccggcgaggtggtgaccattagaatgagtagtagtgtctgggtgcagtgactcatgccccattgaaactgttggcttgcattagggactgcagagtgtgaaggtgcctagtgaaaagccagtaaggtcataaccattagaataggtagtatcagccagccgggcatggtggctcatgcctgaatgatgtcattggcttgcattaggaaccacagagtatgaaggtgcccagtgaaaaactggtgacgttgtgactattagaattagcagtattggctagacgaggtggctcatgcctgtaatcccagcactttgagaggctgagacaggaggactgcttgagctgaagagttcaaaaccagcctaggcaacatagtggaactctttctatataaaaactttttttttgttaaattagaagtagttgaggctgggtgcagtggctgacgcctgtaatcccaggactttgggaggctgaggcgggtggattgcctgaggtcaggagttcaagaccagcctgatcaacatggtgaaaccccgtctctactaaaaacacaaaaattagttgggcatggtggcacatgcctgtagtcccagctactggggaggctgacaggagaattgcttgaatgtgggagataaaggttgcagtgggctgaaatcaagtcattgcactccagcctgggcaacagagcaagccgagactccatttcaaaagagtagtagttggatctaccagcgggaatcttaatagggatgtgagatgtgtttagatctcaaagcctgaccctgagtcttaaaatcccaggtcagatcctaagcagtcccagagagctccacctggtgtgcatctgtgccagtgtcttggggtggggcagctgcatgctcaggtggaatccggggctgagttcaagtttaatccactttatgaagaggaggcagagtgaggcataactcctcatccaggggagtggaagtactgtggaaggaagctctgttttgtacctactacgtgctggccctggcctcactgtgcagaactctccacattggaaaggatccccccagaccagagaggcgtaaggagggggctggtgctttccagtgttgaactgttcatctgtcctcacacccaccatcgggtcctacagcaaatttgtttgattttctgcaaaacacccagaatctatccactccccgtcctcccattgccaccacgctggtcccagccaccccactttctccctgcatccctacaacagctgccacagtggtctcgaggcttttgcccccagccccccacacacacatcagtgtcctcaacctggtggctgtagtgaccttatgaaaacacgcactggccgggcacggtggctcacgcctgtcatcccagcactttgggaggccgaggcaggcagatcacctgaggtcaggagttcgagaccagcctggccaacatggtgaaatcctgtctctactaaaaatacaaaaattagccaggtgtggtggcgagtgcctgtaattccagctacttgggagactgaggcataagaattgcttgaactgggaggtggaggttgcagtgagccaagatcacgccactgcactccagcctgggtgacagagtgagtgactgatggtgaggacacgggctctgaagccacactgcttgggcagagatgccactcattctgtttgttttctcatctgtcaaaagggcctgatggtagtaccttcctcatcaaaacgttccagtaaggggcccagtgaggtggcttcctcctctggtccactgaatgcgtgcgtggcgggcatttaaagcagtgtcaggtatacgtagttacgtgtttgcagtggcgaggtggactgttgagttttaaagagtctactgggcgcaggcactgaccagagaggaagtctgcagccttgatggatgaaattcgtgttccacccaccagccagaccctactggcagcagcccatggcgggggtattaatggcctgggcatcccctctggcgcgtctccagactgccgtggtgtgggcccaacagcagtctcgttagcaggctggcaggtgccggttcccacgtgctggccgcctgtggcccaccctctgctccctggcacacagcctaggaaagagagtctggtggccctgggtcatccccagctgagtttgccaaatgcccacatggcagcccctgcctagggtcactctgcaaggcaggtggctcagctccagccagagaagacaggctgcatctgccgcccttcctttctctaaaggacaaatgtgtcctgtgcaatgactttggtattacacccagaaacagatccccactctgtccttactgactgggtcaacttggcaagtcatgtcaaccccttgagcctcagtttcctcacctgtgaaatggagctaggaataggtagttgtgggtccacagctttgcaggcatgactaggggcaggtcaagaatgcggacttcctgccccactttgaaggtggtagaagctgcagttagaagtttactccaggccaaaaggggcatcacaaaacctgtgaggatgggccatcagaaagtcccatgacctgatgggcggagcaggccctgtgtccttaagaaaaggtggagttcttgccctgccacccctgacaccagcaaagccactgctcaagtatctgtggatgatggatggcagcggggcaggttagaccggggattctcaaccaagtgggtctttttgttttgtgttttttcagacagtcttgctctgtcacccagcctggagtgcagtggtgtgatcttggctcactgcaaccttctctgcctgggttcaggcgattctcctgcctcagccttcagagtagctgggattataggcacctgctaccacacccggctaatttttgtatgtctggtagagccaggggttcaccttgttgtccaggctggtctcgaactcctgacctcaagtgattcacctgcctccgcctcccaaagcactgggattacaggcatgagccactgcacccggcccaactaggtggctttgaccccctgggggattaatggcagtgtcacaagtctggtggcggtagaaggaggatgttattggcatctagtgaagaagaggccaggggcgctgctgaacgtcctacgatgtgcaggacatgtccccacagcacagaactatctggccccacgtgtcaataaggttcagaaagcctgggggattgccttctgtgcttccacgaacacatatccatgtattatgtcattcttgcggcaatgccacgaggtcagtgagactccctgactagcatacataatgttaggatctagggagttgtctaatgtctcacgctgcccttcccagcgatctatgtgtggccttaggcttggctactttagacttagtccctcttttccggtgcctgcagctggtttggtgagtccagtattaatatactgaccgctgtcagaaagaggagtgaggaggctgggcatgatggttcacgcctgtaatcccagcacttttggaggccgaggtgggcagatcacctgaggtcaggagttcaagaccaacctggccaacatggtgaaaccccgtctctagtaaaaatacaaaaataattagccaggtgtggtggtgggtgcctataatcccagctacccggcaggctgtagcaggagaatcgcttgaacctgggaggcagaggttgcagtgagccgagatcttgccactgcactttagcctaggtgacagagtaagactctgtctcaaaaaacaaaaaaagaaatgtgtgaggaatgcaacaagctgtgcattgaccacccttggttacagcaagttctccacgctcagccgggtccagcctttggctgtcagcagcatctggagcggaactgtgaacagaaacactccaggtgttccgacgggtgctggggcgcccccagggagctggaatttggtttttagcaaccacatataggaaatgaacccgccagccacagtatctcacgcctgtaatcccagcactttgggaagctaaggccagcggatcacctgaggtcaggagtttgagaccagcctggccaacatggtgaaaccccgtctctactaaaaatacaaaaatcagctgggcgtggtggtgggcgcctgtaatcccagctgctccagaggctgaggtgggagaatcgcttgagcccgggaggtggaggttgcagtgagtcaagattgcacccctgcactccggcttgggtgacagagtgagactttgtctcggacaaaaaaaaaaaaaaaaaaaaaaagaaccaagtcctcgggcaaattctcccattgagggctgtgaagtcttggctcctctgttgtttgttttggaaaccaaacttgcatatttgactttctcatgcgtggagaggacccatgcttggcatgggggggcacctggtttttgtgtccttggagctcatctctggtgggggaggaggagcagcaggagatgcgagggctgtagttctcagtcctggccgcacattggaatcctatgggggagctttaaaattatacaccaaactcggccaggtgcggtagctcacgcctgttatcccaacactttgggaggccgaggagggtggatcacatgaggccaggagttcaagaccagcctggccaatatgctgaaacctcgtatctaataaaaattacacaagttagccaggcatggtggcgcacgcctgtaatctcagctgcacgggaggctgaggcaggagaattgcttgaacccaggatgtggaggttgcagtgagctgagattgagccactgcactccagcctgagcaacagagtgagactctgtctcaaaaaaaaaaaaaaaaaaaatacacacacacacacacacacacacacacacaactggagaacagagcatggtcactgggggcaggagcgagagtgatgggtgtggtcggaaaatggtggtggctattccgtatcctcaccctggtgtggattcatgagcctacatgtgtgataaaactgcatgggacaaaataaacacacacacacacaggagtacaggtaaaacgggaaatcgagcaagattgttgtgtcaatgtcaacaccctggctgtgatgctttatcctagagttttgcaagatgttaccattgggtgaaatggggtaccaagtacacgaatctctctatattattgtttctttaactgcatgtgagtctgggattatcccaaaataaaagtgttaatttgtaaaaagtacacacagcatggcagttcccagcctcagagattctgatttaagggtctagccgggagcctgggcatgtgcttgaggcccccaggtgagtccagagtacagcggggctgagagtcgctgttgacattggctgcagggtggacagggcgagatgggccctgcccgggcagacctgtgtattgctaggtccttccggctctgatgctctgtgataattggccactttctctgccattttcctcccagagagcaaacacaggtctagactcaatatcgtgtggagctatcgatgaccacgggtcacttccatctccagcactgcaggctgtgcgggctggtccaactggggtacggttgagggtcctggctcagaccaggcctgactcctgggccagtctgtaaaacaggcccttctgggccagcagctgggccgggctgccgctctctgccacctgccccttgtccatgaccagaaccctgtgggggagagggagacagagaggctctttggacaccagcccaggctctcggcagctgtgagagcccagtgtgtctgcgctgaggttttctccatagaagtcctgctttccatgcggctccctggccctcacagctgggttggaagcgtgtgctgggcgcatgtccttgggcagctttcccacttggcatgtgttcccgggcattcctcccgctctggccccattcaggacccctccagctctaacccgaagcccagtggcccaggactgcctccgcctccttcccccaccactgcagggctgctgtgaggtcaggccggggcgggagccttaccgggcacagtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgccagacacaggagctgtttctggcccacgctgggaacgattgggacaattagctgggacgtgcgtttgtcggcacatggtgatgtgtgggtgtgcccagaaacaggtccctgaagcagtgcaggagtgaggtgcctgtgttcaggcatccccacacatggggtctggggtctgtggtctgcagaactgataggaagcctgttcctgccatctttgagcaggctgactgtaggcaggtcattcaaaccctttgtgcctcagtttccccacctgtgaaatggctattttcttttttctgtttatggctctttttttcttcttcgtttttctttttttttttgagacggagtcttgctctgccacccaggctggcgtgcaatggcacaatctcagctcgctgcaacttctgcctcccggttcaagcagttttcctgcctcagcctcccaagtagctggaattacagtcatgcgccaccatgcctggcttttgtatttttaaagtagagatggggtttcaccatgttggtccgacttgtttgaaactctcaggtgatccacctacctcagcctcccaaagtgctgggattacaggcgtgagccactgcgccccggtagttctatttctagtttgttttttgagaaatcatcatactattttccatagtgactgtactaatttatatttcccccaacagcgaaagcacagctttcacttcagtcatgccgttgcaaacaaacctacaatgactgactgctgcttcaagaatcaaatctacagtcttcctaagacattcaaggctggtgtcacgtgggccttaaatacagatgtgtacaacacctgggtgggattccaggcgtgatccaccgtgcctggcctgtttatggctatgtccagttctatttctagtttccaccttgtgccaaacacattctaagtgcttgtatatattcactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgtgtgggtggcggggcacggcggctcacacctgtaatcccagcactttgggaggctgaggtgggcggatcacgagatcaggagatcgagaccatcctggctaacacggtgaaaccctgtatgtactaaaaatacaaaaaattagccgggcgtggtggcgggcgcttgtagtcccaggtactcaggaggctgaggcagaagaatggtgtgaacccgggaggcagagcttgcaagtgagccaagatcgcgccactgcactccagcctgggcgacagagcaagactctgtctcaaaaaaaaaaaaaaaaaaaaaaagtgtgtaggcttgtcacagaataagcccttggcatggagtagcacccttcgtggagggtggaggagttgagattccaggttgtgagcccagtgagcccctgacccaggtgggaactgacccctggggccccagcatggctgtcttgcacagtaagcccttccatgaaacagcatccttttacatgatcagaacctactatggtcatgcaggcgttagagtgcctgggtcttgtcccaacctcactacttttaagctgtgtgacgtcaggcaagccccaggcctccaattccaactctgtgaaatgatgttatcaggagtgtgactcaggactaaaatgagtatttactctttgctctatgcctgccactgtttcaacaactttgtgcatataattcaatccttgcaaggtaggtaggtgctattattcccaccttacagatgaggaaactgaggcacacaagataagttgcctaagatcctacagctagtaagtggcagggcggggcgggggtgggggtgtggggtggggggcctggatttgagcccaggcagtctgtcacctgtgtatactcttacccaccaagcaacgctgcctctctagtgctggaaattattgcctaccacaagcccttcggacaccctcagggtcagaggggtttataaatccagaacaccttaggtttttttttgttttttttgagacggagtcttactctgtcacccaggctggagtgcagtggcacaatcttggctcactgaaacctctgcctcccgggttcaagcgattctcctgtctcagtgtcttagcctcccacgtaactgggattacaggcgcctgccgccacacccagctaatttttgtatttttagtagagacggggcttcaccatattggtcaggctggtcttgaactcctgacctcaggtgatccacccgcctcggcctcccatagtgctaggattacaggcatgagccaccgcgcccagccactttggtttttctaaaggcatatacctatacacctatgttcatagtggcattattcaaaacggccaagaggtggaaacagcctgggtatctactggcagataaacggataagcaaaatgtggtctatccatgtagtggaaaattattcggccttaaaaaggtagagaatctgacacatgctacgatgtggatgacccttgaagacatcatgctgtgtgaaataagccagtcacaaaaggacagatcctatgattctgcgtctatgcagtgtctagagtagtcacactcagagagacaggagaatgctggtggctgggcgctgggggaggggacaaggagagttagggtttcatgggtacagagttgtagttctgttgtgtaacagtgtgaatgtacctaacactacagaaactatacactgaaaaatgggtgagatgggcccggcgtggctgctcacacctgtaatcccagcactttgggaggcctacgcaagttcgactgtagcctgggcaacatggtgaaaccctgtctctacaaaaaataaaaagattacctggccctggtggctcacacctgtaaccccagctactcgggaggctgaggtgggaggaatgcttgagcctgggaggtggaggttgcagcgagccttgacctcaccactgcactctagcctgaatgacagagccagaccctgtctccaaagaaaaagaaaaaaaaaaaaaaaggttgagatagtaaattttatgtgtatctttccacacagctttttgttgttgagacgaagcccaggatggagtgcagtggtgcaatatcggctcactgcaaccttcgcctccctggctcaagcgttcttcccacctcagcctcccaagtaactaggactacaggtgcatgccaccatacctggctaatactgttgtccacagagatagggtcttgctatgttgcccagactagtctcgaactcctgggctcaagcaatcctcctctctcagcctcctgaagtgctgggattacaggcatgagccactgtgcccagtccacacttgacatttaccaaaaaaaaaaatcctatattatagtcccagtgagtggtgaggttaccacccgatatcaaacaatattttcatagcaaaataaatactgagcaagagcaataaaggctatcagtagccctgtgtcagttgaggttgggttttgccaccaagtaaatatagaagactaactgctaatttaggggggaaaaccttggtattcagagactgtgtcagagcttggaattgcagataagagacatgtggttattaatgtaacagagtgataatcctatcgggggaggcatttcctgaaggcccttggggagggcatggccatcccctcctctcccacctgcaggtcccagccatggtgggacgaccatacctcaggtcctcgcctcggtcagcacacttgtactgcagctggccgggcaggctggccaccaaggctttgagctgcaccgtctccagggctgcccagatagcctcgtccgagtgctcctgcagcaggtcgaggttcatccgcagagagccagggaacaggatggggtcctggcggggaggggcggtgggtcagagccgggtcccaccatgcctcccatctttgcccaccccctccaccagcctcacctgggggatgatgctgatcctggagcgcagtgtgtgcagccccacgtgggcaatggggaccccgtcgatccagatcccaccctcagctgcctcctggagccgcagcagcccactggccagggaggacttccctgccccggtcctgccaacgatgcccacctgcccggggttgggaggaaaggcctgctctgaccagagggtttgtgggcatttattggggagatctttctgctgtacccgagatctgtctatccatccctcattgtgtaaaggtctaccttccatctctctttccatctgtctacctttctatatatccacccatcaatccatccagtcttccatctgtgttcttctctatctttcccttatcctgatatctctctcccatctttctccccacccttcctttagttcctccatctttcctcatccttctatttacacctctccatcatctctcatccttttttctaccccatcccatccatctgtctgtccgtccatccatcccttatccttttttccaccccatcctgccatccatccatccatcatccatcctcaatcccatccctccatctctcttccaccccattccattcatccatccattcatctgtctatccgtctctcgtttcttcttccctattcatccatcaattcactaatcctttcattcatttattttctcccatccatccatccagtccatccttccctcatccatccttccattcatcctccatcttatccatgtgtccattctgttatccatctcccatgctgttatccaccctccatccttatctctcttgctactattgcatcctcagtgtctgacacatggtgtgggttcaacattatttgtttaattaatgatggaaacatgtgggtcaccccactgtatgccaagtacctgtttaggcaccggaagtatagaaattaaagagtccttgctccagtgtgcccatcatccggtctaggaaacagtgcaattgagtaaatgtaatacagtgtgatgaacaatgctttatttatttatttatttatttatttttgagataaagtcttgctctattgcccaggctggagtgcagtggtgcgatctcagctcactgcaacctccacctcccaggttcaagcaattctcctgcctcagcctccctagtagctgggactgcaggtgcctgtcaccatgctcggctaatttttgtatttttagtagacacgggatttcaccatgttggccaggctggtctcaaacttctggcctcaagtgatctgcccaccttggcctcctaaagtgctgggattacaggtataagccacagcacccagccaacaatgctgtttattatcaaggtctggacctctggcaattaagggaagcaaggcagtgctgctcatgctgcctgggatttgacagaggtaataagagaagacctcatggaggaagggatacttgcatggaagcttgaaggatcaataggagttcaaggaaggggaacactccaggtaaaccacaccaagtgggtttccaaaactagaagctcatggagctcacagcaccatgtgcccccctggccgagaggcagctgctccacaatgttggctaagccctggcagagcaatgaatgagagggggaggttggcagggcctgggttgggtagagccttgaatgccaagctcaggaattcacactttaccccaagggaagctggaactagtagaaggttttgagcaggggaatgacatgcagtgtcattcatgctgataaaggtcacaggatggctgggcatggtgggtcatgcctgtagtcccagcactttgggaggccgaggggggtgattgaggtcagaagtttcatagcagcctggccaacatggtgaaaccctgtctctactaaaaatacaaaaattagccgggtgtggtggcaggtgcctgtaatcccagctactcaggaggctgaggcaggagaatcacttgaatctgggaggcggaggttgcagtgatctaaggtcacaccactgcactccagcctgggcaacagagtgagactctgtctcaaaaaaaaaaaaaaaaaaaaatcacaggagagcagattggagctggtgagacaggatccactgctttttaggggacaaggagaggacagggaggaagcctctgtaggttcagagggagggaggaaagggattcagtgaaggggcctgatgaggcatctgtaaaatgggatagtactagcacctcacttaggggttgttgtgagagtgaaaacgcaaataataaaagcattagtaaacatttctggagcactttctatgagctaagcatgttctatgtattaactcaaacttcacaacaactcagagatcagtattaccagtcccaatttacagatgggaaaactgagactgagctatgaagtgcttttcccaatgtctcccagctgaaagcaaatatcccatttgtgcaaactggaaaatgtacctggagcatttaacacactgcccagcacatattaggtgctgggttaatgttaaaggaagaaggaagtcacggagttgcttcctcatctggggacaccaaggtggatgaggaagtcaccagatggaagcaggtttggggaaggtgaggagttcattttagggggtaatgggtctgaaagctaggggacctgaggtggggacactgtggaggtggctggtgcccagggtttagggccttgtccctggagtcctttggcctaaactccatgaagaagacattgtgagagaaccactcaccttctctcctgcgtggatcttgaaggacacgccctgcacagccagcgggagctcaggtcggtatcttagcccaaagtcccggaactcgatctgcccgccctgaggccaggggggctgagctgcacatgtgggcagcctccagggagcctggagcaggaggggaaactgagtcagaggagccttcctctaagacttcacacaagatggcccacctctatcagcttcagttttctcttccgcaaaatggacgtatttattgctgttttacagggttgttatgggaattcaacaagagagggcatggactatgtcaatgctaaaaacagatggtggtggctacttttagtctattttattgttattattagccactgtttattataaaataatctctttttctatagtgggagcagacatttctctttgtctttgtgaaaggacatgactgtgcagtgggaagaccaatactgcctttgctgttcccgtgaccttgaacagatcattctacccccttgagtcttggttttccaatctgggaaatagggctaataagagcagcagacatgtattgagtgtttgcaatggaccaggcactctattaaatcatttctttgcaggatctcatttgatcctcccagtaaactcaacgctgttatgttactgttacattagtgctatgctgctgttcttatcctttcttccacccaatcccatccatccattcatccatccatctcttatcctttatccaccccatcccacccatccatccatccatgcatccatccatccatctccaatcccatccctccatctctcattcttccatcccattccatccattcatctgtccatctctcaccatttcttctaccctattcatcaactaattaattcttccttgttctgttactgtaatgttactgttatattgctaacacattatatcatgttgctgttttgttaccgttgcgttgctatgttgctgttctgtccttataatgctactgttatgttgctggaattttgccatcatgttactataatgttgctgttttcttactgttacattgccatgttgctattccgttactataatttcagttattttgctggaatgttgccatcatgttactataatgttgctgttttgttactgttacattgttatgttgctactctgttactctgttacagtcgtgttgctgggatgttgctgtcatgttatgatgttgctgttgtgttactattgcattgctatgttgctgttttgtttctatcatgttactaaaatgttgctattacgttactattacattgctatgttgtggttgtattgctggaatgttgccatcatgttactataatgtctctattatgttactattacactgctatgttgctattctggtactgcaatattgtggttatgttgctgttacattactgttacattgctgttgcattactctcatgttctggaatattgccattgtgttgctgttgccattatgttactatcatgttgcagctatgttgctgttgcaatgctgttccttgtggttccctgcactcccatgggtgacctgctttcctcaagctcagaagcaaaggaaccaagatttggcctggctccaaaccttatgctcctaaccactgctgccaccctgtctgtgactctgacctatagtggtgggggttgagtgaggggagaagagggtataaactccaaagcctgtagcagatgtcaacagggacccattgcccccccccacaatatgtccttgctgggaccccctccccacctcccgcccatcacctccttgggcgtccaggcatagtcctgcatccgctccactgacacgatgctgttctctaggtctgtccagttgcgaacaacccactgcagtgtctgggtcacctggtgcaagaaagcctctctggctgggtttggcaaggccacttgagggcttgcaacagcccccctggtttcccaaccttttctgggaggccagacccaggggagtaaagaggggaggcaggaatgggacagtctgaggacctgggcccaggggattgggatttggatacaaccaacaggtccctctcttccttcagtagaaccagagcatgcagagcaaaaagaagccctcagacatcagcttgtacaaactggcttgatgcaggtgagtagacaggatcagagagggtgtgtggccctcccaaggacacacagcaggacccaggcccactgattccattctgacggctttctcgcagcgactgggtggccaccaatttcccatgacacttagaaccactccaagctcctccctatgagccattagcagctctagccctgccatcccatccccaaccttgtctcccagcacccctgccttcacccaccctctccagccacacccgtcttcttgctgttcctctaacacaccagggatgaaccttcaactcccaggccttttcttcctgctgttaacctcacttcctcctaagtcacctcctcagagaggcctttctggatgcagtaggaaagttccctcactgccacccaacatgctccagcctcttacttcatccttaagcttagcagccttgactgtaaaatgaggataataacagtgcttctctgatggggttgtgggcagtattaagtgagttaatatttataaaattcttgtgcacagtggctcatgcctataatcccagctttttggaagtctaagcaggaagattgtttgaacccaggaattgaaggctgcagtgagctgtgatcacaccactgcactccagtctgggcaaaagagtgagaccttgtctcaaaacaaaacagctgggcatggtggctcacacctataatctcagcattttgggaggctggggcaggcagaccacttgaacctagagtttgagaccaggttgggcaacatggtgaaactgtttctaccaaaaaaaaaaaaaaaaaaaaaaaaaaaattagccaggcatggtggtgcatgcttgtagtcccagctaattgggaaagtgaggtgggagaatcccttgagcctggagatggaggctgaagtgagccaagatcatgccactgcactcaagcctaggcaacaaaatgagatcctgtctcaaacagcaacaacaacaaaccaaaacgaacaaaaacatataaagctcttagaataatgcctcctccataacaaatgcttatgagtgtatatatatatttttttcatagatgtcatgaactgacattacatactgttaatagttaacaaaaattagccaggcatagtggctcacgcctgtaattccagcaacttgggaggctgaggcataagaatcgcttgaacccaggaggcagagttctcagtgagccgagattgcaccactgcactccagcctgagtaaaagagagagactctgtcttcaaaacaaaacaaaagttaacaatgcactagaaatgtcctccacaggatatgctttgtctcaactagtctttataacatcagaagtagtgggatttctggcctgtctttccaaggagcacactgacactccacaaggaaagactcttgcccaaggttgcaagttcaccttagctgagtctggctcttgtagagctgcgtgtccctccttggtggagggactccacacaccatgttggtttggacacagggtcttcaaaggtcccactagcaggggtccgacagtctctgcctctgtctgtccctcaagcccagtttggggatgtggggagtacctggagggcagcagagacagagaagcccacgaggccagcactgaggtgggctttgctcagcacagcacacgtggcagctgcaaacaccaggccattccccaggagctccacattggccgcaagccacctgcaaagggaagcgacagcagggtgagtggttactctcatctgcagggagatgcttctctgggcacaaggactggtcatcacaccagctttgtacacacaggggtcccagcaatggcctccacatgcaacccaggctcagggagtagaggaagatgacaccgtcctgtctcaactaagcccactttagggtctggggtacactcggtgttctgaagagcatccctgtgtggctgcttttctgtccctggaatttgccaagccatgtccacctgccattcccctggcctgaaccatggcctccatggtttggctctgtgtccccacccaaatctcatctcaaattgtaatccccacatgtggagggagggatctggtgggaggtgactggatcatgggggcagttttccccatattgttctcgagatagtgagttctcacaagatcatatggcgtaaaaggatgcggcagttcccacctcatgctctccctctcctgctgccatgtaagacgtgccttgcttccctttccaccatgattgtaagtttcctgaggcctccccagccacgtggaactgagtcaattaaaccttcctttctttataaattactcagtctcaggtagttctttttagcagtgtgaagatggactaatacacagccccagctggctggggacctgagatgaaaggaaaaaggacttcacatgtattgagcacctagtgtgtacttgaccctctccacactctggtaccagactgcttggattcaaatcctggctctgccagtattagctgtgagaccctggacaagtttccaaacctcactgtgcctaggatttatcatctatagaacagtttcttcctggtgaagctgttagcagaattaaataaattaatctacatagattgctcagaacagtgccaggcatgcagtaagcatgttacaggtcttacctatgagtgtctgtatttaatcctcatatccactccatgagcacgatcccagtttgacaaatgaggctcagagaggttatgtaacttgcctgaaatcaaccagctggtaagtggcagagctgggatttgaacctgtgtctatttgtgcttaaagcttgtgttcttgttcttgcttagtacctaaagatggctgaggatgcttatatggctgctttatcaccaaggcaaaagaggttgatccagttgcctggcaacagaagcttcttcctgtaccccccgcccacctgctgttgagaatctctcggtcatgttccatctgcccacggtgagaactgatagactgcctgtgggatctagcctcaactatgtccctgactctctgggtgacctctctaccatacaatatgacctcaggtctcaccctctaaggatatggatgaattgcaaggtcttctctgccctggctcttcctacctgtcagccaccagtcgcgggaaactgatcctctggctttcatctacgcgagcattgttctgagccacaaagggggcctgggttcggaatgcccggaccactgtgctgccctggaacgtctcagccatgtgggagcagacagacgagtagctggctgactccaagcgtctcagctggcatgagctaaccacatacaggctctgagaaggatggatgggagagggaagaggagaagccacagacatagagaggtagtttccagaagcacagagagccccaagtacaggattccagaccaggatctgttaacagcttactgtgtgaccttgggctagttgcttgccctctctgggttctcatttccttgcagaatcagagttctatggtttttttgaaaatcacctggggagcttcaaaaacctctaatgccccaccccagaatgactgaatcggaatctctggaaatgtcaccttgactttggtgctgtttaaatagccttccagatgattctaagggacagccagggttgagaaaccaccaatttagtttaagtgtctcacttcccagcactgaggccgactacttcatttacggctggtcagtgggagaacaaaactgtaaggggcaatgaaggcagttggccaagtcagtttcactcatgtaacccaagggttacatgccaggtgatgtgcagaaaatattcgttatttggtttgcagctgcaggttgggtgcagctggcagacaggcaggcagggaggaactgaatttgctgaacacccaactgtatgtgccaggcttttcacacagtgtctcattcattgcagagtgagcattcgcgtcattcatcagttagtggtgagaacatccaaggctcgggggattcagcagctgtcctgagtgccacagtaagtgatagagcctggatttaaacccatctttgcttgactctaaagcttgagacagaaacagcccatcctcggagtcaagtgaacttagagaagacctaggacaattgtcggggacagtggtagccatgggttttgttgtttgttttttgagatggagtctctctctgtcacccaggctggagtgcagtggtgcaatctcagctcgctgcaacctctgcctcccgggctcaagcaatcctcccgcctcatcctcccaagaagctgggattacaagcatgcgccaccacactggctaaatttttgtatttttagtagacggagtttcaccatgttgaccaggctggtctcgaactcctgacctcaagtgatctgcccacctcagcctcccaaagtgctgtgattagatgtgtgagccaccatgcctagccctagccatggtttttatctgactaccatgttttctacttctggtttcctgtgggaaagggctgggttggggtgctgtcaatcatgggacctgatcagagaggtggtcacatgatgcagcctagtgtatcagaatctactatccattcagttactgtgacgagttcagagatggacacatgatccacaaagggccaatcagaaccttccctgggattaatatatgactactgagctgaagaaacgttttttgcatgttgagttgctaaggtgagatgatatgatagctagtggccataagacctgccctggaaagagagcgtgtacaaaattagaccagaggtaagccagtggttcctaaacatttgtgtacatcagaattacttggagggttaattaaaacctagattcatgggccgacccacatagtatctgaggcagtagtcctgggctggggcctaagaatgtactttgctaactagtccccaggtgatactactgctggtcctggggtcacactttgagaagcactgagtgaagatatggagagagtcactgtgtcctgatgacaactgggcccatgcccccaaggaaatataagccattaaattctattcttttggttaagctaattttagttggttgctggtcccagcaattgaaagaatctagcttcatataatagcctttgagaccttgcaatgcctttttggcttccagataattggagaggaagaaattacggcaggataaaaacattacgcgtgaaaggctctggcccttaatatttaactgtgccgtggggcacaggggctcatgccctgtaatcccagaactttgggaggccaaggtgggaggatcacttggggccaggaattcgagaccagcctgggcaacacaggaagacacttgtcctacaaaaataaatttaaaaattagccagtcatggtggcacgtgcctgtagtcccagctacttgagaggctgaggtaggaggatcacctgaacccaggagttcaaggctgcagggagctatgatcacctattgcacttcagccttggcaggagagcaagattctgtctctctaaaaaaaagaactttgatgtgaacatttagagacagacactagtggagataccagaaagactgtagtgtccctgtccctgggaattctaggaacagcccctagatgtccagctgggtgaaacctcatatatggagtcttccccagagacaggggactggctgagttgacctcagccggtcccggaagcctccctgacctctccgtacctgaaacccagcgtagaggagaaacagtggcaggatggccacagtggccagtggggtagccactgccaccaccaggctgacctccaggagtccaaaggcgtacatcagcagggaccggagtttgtctggaatgtccacgtcaaccgtgtctgtctccttggagaagcggtttagcaggtgaccaatgggtgtccgctcaaagaagctgatgggagatcgcaccacatcccacaggagcctctggaagagcaacctggatgcccgggccccacctaggagcaccgcagccatggaggcaaacagcccaatggctggggagggagaggaggtaagagcatgagggctggagaccctcaggagcggcccacggggccctgcgcaggtctctcccgctaccccatggtggacatcttatggcttggccaccctgattattatatttttttgagacagggtctcactctgtcacccatgttgaagtgcagtagcatgatgatggctcagtgcagccttgacctcctgcactcaagcgatcctcccgcctcaccctccgagtagctgggaccacaggtgtacgccaccatgccggctaatttggggtatttttgtagagatgggatcttgctatgctgtccaggctggtctcgaactcctgggatcaagtgatctgcctgccttggcctcccaaagtgctgagatgacaggcatgagccactgcgcctgtaccctgcttgtttcttgatgtaatgggttgaagagtgtcccccaaaattcatttgggatgggtcctaaattcagtgactgccatttatataagaatactagaggatactcagagacacagcaggagatatgaagatggcgacacagatgggagggtgtatctacaagccaaggaatgccagcgactgccggcgaccaccagaaaccaggagagaagcctggggcgtattctccatcagaacctccacgaggggccgggcacagtggctcatgcctgtaatcacagcactttgggaggccaaggcgggtggatcacctgaggtcaggagttcgagaccagcctgagcaacacggtgaaaccctactaaaccctactctctactaaaaatacaaaaattagctgggcgtggtggcaggcacctgtagtcctagctactcaggaggctgagtcaggagaaacactggaacccaggaggcagaggttgcagtgagccataagccgagatcgtgctactgcactccagcctggttgacagagcaagactccgtctcagaaaaaacaaacaaacaaacaaaaaaaccaaaaaaacctccacaaagagttaacactgctgacaccttgattttagacttcaggcctcagaactgcgacagaacaaatttcaattgtgctgggctcccaagtttgtggcaacttgtttggcagtagccctgtgagagaaatgcacatccttcctcccagtgctaatctgtatgcctggggtggggctaacttctcctctggggtggggcaaatttcacccatggccaatccaaaccactgcagttggttcagggatgaacacataacccaagtcaggccaatgacagggagacctgggacttcactagaacttttggaaaagtggtacttggttgttggaggtagccaagctggagccgtggaatatcatcttactgccagggggagcagctaagctggacaggaagctgtcacagaggagggaaataaagcgatttcttgtttggacccctacatccagccatacctgaagccagaaatctagggatactggtcccaagagccaatcaattctcttgttgcttaaacactttgaattggagctgaatttgtttattttcagacggagtcctgctctgtcacccaggctggagtgcagtggtgcaatctctgctcactgcaaaccccacctcccaggttcaagcgattctccttcctcagcctcccaagtagctgggattacaaacactgacaccatgcctggctaatttttgtatttttagtagagacggggtttcaccatgttcgccaggctgatcttgaactcctgacctcaagtgatccacccgcctcggcctcccaaagtgctgggattacaggcatgagccaccgtatctggcctggagctgaattttttattctttgtattcgagagtcataaccaatttctctctctcagctcccatctctccatctttaggggagagtaagacttgcccttagctatcaaatgagggatggaagtggaaggattttgaaagggctatttgccacccaaatgaggatttgggttaattccagggctcggctgactctgagaatccctaatttcctcttggttaagtaaccattcgccttgagtattccactgtacatgcagttgtggtgagtaggtgtacaggttcttaggactagaagagtcctcaagttcaggcctggcgccccctattttacaggggaggtcacaggctcacagcattttggtgatgtggccaatgtcacccagtgaatgaggacgaatcaacatgaaaacgaggcaactgtcctttaaagatgaagccaggccgggcgtggtggctcatgcctgtgatcccaacactttgggaggttgaggcggaggattgcctgagcccaggagtttgagaccagcctgggcaacacggcgaaaccgtctctatcaaaaacaaaaattagccagcatggtggcatgtgcatgtagtcccagctactcgggaggctgaggtgggaggattgcttgagcccaggaggcagaggttgcagtgagccgagttcgtgccactgcattccagcctgggtgacaaagccagacccagtctatatatatgtgtgtgtgtgtataaataagaagccaaactcacatgtgcactcctgttactcccttcagccaggccacgtattaaaaggagaagaaccaggggttggggacagggtgggcgaggcaggagaagggtgggtgtggttgcaaaagggcaacacgagagcgcctcgtggtgagggggttgttcagtatctcaactgtcaaccatcgtgatggatgcgagagactgaacaggggatacgactgcacagaggcaaacatgcgcacacccacgtgcaagcaaaactggggaaatcacaatgagatccatagggccgggtgcgggggctcacacctgtaatcccaacactctgggaggccgaggcgggcagatcatttgaggtcaggagttcgagaccagcttggccaacatggtgaaaccccatctctactaaaaatacaaaaattaaccaggctgcacacttgtaatcccagcttccagctactcaggaagctgaggtaggagaactgcttgaacctcggagatgggggttgcagtgagccgagacggcagcactgccctccagcccgggcaacagagcaagactctgtctcaaaataaaataaacaaataaataaataaataaataattgagatccatggattgatgggtgtcaggatcctttgtgtgatactttactatcagtttgcaaaatatcaccaatgggagaaactgggcagactgttcaaggtagctggctgccttatttcctagaactgcatgtgaatctacaattatttcaagaagaagtctttccatttttgaggaggagaagaaggagtgatagcggtgatgcatttgttagggagggtctggctctgtctggaggtttgggggcaggcactgaaagccaccagcaggcaggccttgcagacgccttccgctagtggggagggactgggagaggttctgaagcttccagaaaaggagggatgtgccctgtccttcccgttccctccagcctcatcttaaggacgcagatctttgcctggaccccagacgttttgcacactgttccagggggacagggtgacccagggaggggtggggtaaaggagtcctgagcaccccttggtgcagctgggaggagagggatgaggagggcaggtgaggcgtaccttggagacagccgaggagcccgaagatcccgccacgcagggctgcctgcgtctgctgcccacctactgcagggtcgtccgcccacaggctcagccagtagccccggcagaaggaggccacttgctggcagaggaagaggaagagtgcgtagaggcagaggggggtgcccacggcacgcaggtaggccaggtgcactgtggccttcacctgtagcacacatgagggagagggaggcagagagagcccccagtgggaggggtgggttgaggcaaggccaggcgaggctcccagaaaacatgcccatggcagatgggaccaccacgcagacctcactggttctcccgctgtgcctcccaccagaagcaccatttccccgacaggccccagccagccttagaacccccatctcctatacaatccccagggagctagtattaatattttttcttttgttttttttttgaggacagggtcttgctttgtcgcccatgtcacccaggctggagtacactggcatgatcatggctcactgcagccttgaactcctaggctcaagtaatccccccgcctcagcctcccgagtagtcaggactataggtttgtaccaccatgttttgttaattttcatagttttaaagagatggaatctcgctgtgttgcccaggctagtctcagactcctggcctcaagtgatcctccctcctcggccttccaaagtgcttggattacaggtgtgagccaccacacccagctagaagggttttcttgaacacccaccataggtcaggcatgtgtctctccttataacaacctccatttcacagataaggaaactgaggcacagagaggttcagccactggcttaaggtcctgctcctacaaatctgaagttctctgcacagctgcagccagacgggactgttgaaaacattaatctaattatatcttgtcgttggcctgtccatggctatctcttgctcttagaagaaatcccagccaggaggggtggctcatacctgtaagcactttgggaggccaaggcgggtgtgtcacctgagctcaggagtttgagaccagcctggaccaacgtagtgaaaccccgtctctactaaaaatacaaaaattagccacgtgtggtggcaggcacctgtagtcccagctactcgagaggctaaggcaagagaatcgtttgaagccaggaggtggaggttgcagtgagctgagattgcaccattacactcttctctgggcgacaagagtgaaactctgtctcaaaaaaaaaaaaaaaaaaaaaagaaagaaagaaagaaagaaagaaagaaagaaattccaagcttcttatctcgcccccactcactgcctgccagcctcatgggacccctttctctggcaccctaagctacttcccacctcggagccattgcacctgctgctctctctgcctggagcgctctttctcctgccctttgtatgactggttccttcacacattctttggggaagctcaaatgtcacttctcagagcatcctgtccataccaaccatggtagggtttctcagtggtctctatttcatcattctttcttttaagaggcagggtctcactctgtcacccaggctggattgcagtgacatgatcatagctcactgcagcctcgaactcctggcctcaagcaatcctcctgcctcagcctctgaaagtgttgggattacaggcatgagccactgcgcctgatcattcttattttctttatagcacttattgttattggacatagcttacttattagcataattatttactctccgtctatcctcactagtgtctaatctctaccagacttagcctggcacatagtgggtattgtgtacatgtttgctggatggatgagagggtaggtgggtgaataaatgagcgggtgggtaggtaggtaggtgtgtgaatgagtggatgaatggatggaaagatcaatgaatggatgaacagctgaacagacagatgcataggtgagggaatggttggatgtattgttaggtgggatagatggatgggtaagcgaatgggatggataaatgagtaggtgggtgagtggatgggttggacagataaatgagtgggtgggatagatggataaatgagtggatgggatggacagataaatgagtgggtgggatggatggataaatgagtgggtgggatggataaatgagttggtgggagggatggataaatgagtaggtgggatggatggataaatgaatgggtgggtgggtgggtggataaatgggtgggtgggatggataaatgagtggttgggtgggtgggatggataaataagtggatgggatggataaatgggagggtgggatggataaatgagtaggtgggatgcataaatgagtgggatggataaatgagtgggtgggatggataaatgagtgggtgggatggctaaatgagtgggtgggatggataaatgaatggatgggatgcataaatgagtgagtgggatggataaatgggtgggtgggatggataaatgagtgggtgggatgcataaatgagtgagtgggatggataaatgggtgggtgggatggataaatgggtgggtgggatggataaatgagtgggtgggatgcataaatgagtgagtgggatggataaatgggtatgagtgggtgggatggctaaatgggtgggtgggatggctaaatgagtgggtgggatggctaaatgagtgggtgggatggctaaatgagtgggtgggatggctaaatgagtgggtgggatggataaatgagggggtgggatggatggataaatgagtgggtgggatggataaatgggtgggtgggatggataaatcagtgggtaggtgaatggatgggatggataaatgagtgggtgggatggataggtgggtgggtggatgagcatctaggtggatgatggaatgggtaagtaggtgggtggagatacatagcagtatagaagatgagaaacagtgtaagcttcagactcagattggcctagatttgagtcccaggttgtgtcccaggctagatatgaaaacacaaacaagtctcttaactgtttaagacttcagtttcttggctgggcacagtggctcacacctgtaaccccagcactttgggaggcagaggccagaggatcacttgagcccaggagttccagaccaacctgggcaacatggcaaaacccatctctactgaaaatacaaacattagctgggcatggtggcacacgcctgtagtcccagctacttgagagactgaggtaggaggattgctttagcccaggaggtcgaggctgcagtgagctatgattacatcactgcggtccagcctgggtgagtgagcgagccactttctcaaaatcaaaataaaataaattttaaaagaattcagtttctttatgtctgaaatagacctatcatatctattttttagggtggttgtgaggattaagaaaatgaacatctagaatgctactggcacatagtaggtgctcaagaaaggtgagtatcactgccaagtgctacatttggtgggaagacttgggcccctggaggtggcagcagtgggtggggaggggtgggtgaagctggtggttaccctgccgtattggatgctgtcctttcctgctggccatcctgccctgtcagggtcatccagaggaacctctgtctgggcttctgaagtggtacggtccttctcagggactgacttgatggacctgtcatttagaggaaatgaagacaaagtcagtatctctcccaatggtggggtgtatgtgcctaaccctcaggcccactgacagccactgagctctgggtacactctgtactctttcattcattcatttatctaacagaatactgaccagatatcacacttcccttcttcccatatggtacccagctaaatgccatctattaccccagggtcaagcaagcccattcttctgatgccaattcacaggatgaacttaacttgcccaccattggaactctgttctcagaattttcttttttttttttttttgagatggggtcttgctgcattgcccaggttggtctcaaactcctgagctcaagcaatccacctgcctcagcctcccaaagtgctgggattacaggcatgagccaccatgcccagcctgttctcagaatttttattttggcttaagctttcgtgcaattgttttgttcctactgtataccatcagatttgtcagtccaactggcagaatataaattatgcacaattcagatgctaaagactctttgaatgttttatctgtggatgagtgggctgacttaacctctgtgcctcagtttcctcagctgtaaaaataggaatattatctatctatccatccatccatttatccattcatctacatacctgtatatctacatatacatgtctacctaccttctattaaattgaggttagcccaaagctgcctccttacatattttaagtttggcctaaaggttttccccgtacatagtgaactgtaacctaattggactcaaacagactgcaacctactcctgtgtcaatcactgagtttcagccaatcaaaggcaaccaaccgttcaaaccatgttccaataaagcaaacgctgagctgtaaccaatccggctgtttctgtacctcacttctgttttctgtccttcaccttcctttttctgtctattaatctttgaccccgtggctgtaccagagcctctctggacgtattctggttcagggactgcccgatgtgcggatcattctttgcttagttaacctctgttagccaggtgcagtggctcacgcgtgtaatcccagcactttgggaggctgaggcaggtggaacacctgaagtcaggagtttgagaccatcctggacaacatggcaaaaccctgtctctactaaaaatacaaaaattagccgggcctggtcacatgtgcctgtagtcccagctactcaagagactgaggcatgagaatcgcttgaacctgggagacggggattgcagtgagccgagattgtgccattgcactccagcctgggcgacagagcaagattctgtctcaaaacccccccccgcaaaaaacaaaaaacctcagacacattaaatttgctagaggttaatttggcacaatctcggctcactgcaacctccgcctccgaggttcaagtgattctcgtgcctcagcctcccgagtagctgggactacaggcacatgccaccacgccggctttttttttttaatttacttattttttatttttagtagagacgggttcaccatgttggccaggctggtctcgaactcctgacctctagctagtgatccacccgcttcagtttcccaaagtgctgggattacaggtgtgagccaccatgcccagccttaatgtgtctactggttttcttttaacatgactacctatccatctgatcttacttcagattcttgtgcgctgtgaaggtggtgggatttctcagtgtgtgtgtgattgagaagtgccctcagggtggctagctgggatgggggtcagccccaatggtccctggggactgaggcccctcaagatcgctgccgcccaccacccctgtatagcaggcacttaagctcaggccatctggtatcagtggcctgttgttctgcttcccaagacccctctcattaagaggggagagtatcaggcagcaggtccttctgctgccgacagctccacagtgagcccagctgtgtcctggctggagggagctgagaaaagaggggaccggaggcctcctcctggccccttgcccacgtgttctggccagcgtcaagtgatgctgtgcatacagacccaagccctgtgcatagccagcctgtcaaagcataagtggccaggcctggcatggtggtttacagctatggggaggaaccagtcctgccctactgcagcattcagacaactccagcaagctggcctcggcccacttgaagacatccatcaattggaaggcatattgttcattccatgaactggccttataggggcctaatcatcttggctaactggaccaattttggtaaattatccctcagcagggcaccatgggggggacttcagcaggttctctatccataatggttttggttgcccgcctaactgcccgagatgcgggtggtcccttcagctacttcagcttcagcctgtgcccttctgagtgtggcaccatggtggactcacctctcgcgtctaagctcgggcctcctgcctgcagaggtgcctctggggtccttggtgctggtcccaggttctgtttctgcaaggtcaagagagtcctgtcacgcaacacggcccagatacccactttgacacccactgactatgtggccttaaccgctctgaccatccatttcccctgatctggctcctgccacgtctccagcaacctctctcaacaccccactctgagttcttccaggaacatccttcaggcattcactcactcattcatttcttcaatcagtgataactgagcacctactatgaacttgaggttggaaaaacagcatttaacactgtacaaagtcaagttacctctgtttcccccaacagccttgctcaagcagttccttgtgtctggaatgcttttttctggctaactctcacctaccctcaggtaccatctcccctaggaaggacacctccccaccactatcccccaggtgtggccagtaactgaaagcaaatctgtagtagtttaaccacagacctgtaagcaacaagtaactgctactgtaagctgctaggatttggggggctatttgttacacagcatcatcacagcaaaagctgaccaacacaaacaggcaagttctatcttcaagcttcaggactgtgacattgtgaatcaacacttaaggttttaaccaggttgggccagtgctaagcagatgttctcagaagaagcaaagcctgagattgagggagacctggatgtgaatccttgctttgtcatgaagggatagtgtagagggtagcaattaaaaaacacattctctggaatcaagttgcttgggttcaaatcccagtgctgccacttacaagccatgtaacctgggactagttccttaacttctgggcctcagtttcctcatctgtgaaatggaaatgattctagtaccagcctcacaggggcattatgttgattaaatgagctaacctctgtgatgtgctgttagttgctacttttcagtcattgtgagtgagcttggcttggcaactttacttccagaaccttgccatgtatccagcacactgtttttctggattattagaaaccctagctagcatggtgtagcttgctaggcatcaaagtccttcttgggctgtctccatagcaactgcaagcatagactctggagctggacatactcaagttctaatcttgtgaccttgggcaagtgatttaactctctttgcctcagtttgctcatctgtaaaatgacagcaataacttcacatgcctctggggcatgtgtgagaatcaaatgaaatagtgtattttttacagaagcacttagcacaacccctggctcatggatgatgttatcggctattcttggagaaaggtgacctattaagagagctgtctgcttccaggcctaggcctgcagacagggtgtggccagagcactccattcatgccagtaggacccttcgagccttttcccccaagggtggcaggagccaggcctggagaatcagcaaagcccacctagtacctccttctcctctatctcctggctgtctggcttgatccagaagacacatgagggcccccttcctctgcagaagctcctggtaggaacccatctctgcgatggccccatttgccagcactatgatccaatcagcctggggcaggatgtggagtgcgtgcgtcacgagaatccgtgtctgggcagggaaggggtagaagttacacacatgtggccgggtgcagtggctcatgcctgtaatcccaacactttgggaagccaaagcatgtggatcacttgaggccagaagttcgagaccagcctggctgacacggctaagccccatctctactaaaaatacaaaaattagctaggtgaggtggcgcacacctgtagtctcagctactttggaggctaaggcaagagaatcacttaaacctgggaggtggagcttgcagtgaggcgagattggaccacagcactccatcctgggtgacagagcaagactctgtcaagaaaggaaagaaagaaagagaagaaaagaaagaagaaaagaaaagaaacaaaggaaggaaggaaagagagagagagagaaagaaagaaaaaaaaaatgtacggccgagcgcagtggctcatgcctgtaatcccagcactttgggaggccgaggcagatggatcacctgaggtcaggagttcgagaccagcctggccaacatggtgaaaccctttctctactaaaaatacaaaaaattagctgggcgtggtggcgggcacctgtagtcccagctactcgggaggctgaggcaggagaatggcgtgaacccgggagccggagcttccagtgagcggagatcgcaccactgccctccagactgaaagacagagcgagactccatctcaaaaaaaaaagaaaaagaaaaaagttacacacatgtgcttggccagcctcctgagctgggggttggggtgggggtattgtccctggactcagagtggggacagctccccttcttgtgctcctgccgcctttcttgtaaacagcatatccaaatagagaaacagaggggactcccttagcctgtgtctcaaaacaagaagacaaggagtacatctgaccctggccaatcatccaaggcaaagctgtagtagttaaatcacagatccataaggaagaaacacctgctgttgtaagctgctgggatctgggggttgtttgttacatagcattgtcacagcaaaagctgaccaatacaaagaggaaattggactcaagtggaagggggaggtgagataaacttgggttaggactggatgctaagtgcttcctctgcctttgccctgtactgtctgacacatgttcccaaacttactgttccctggagtagtccaccaggcccaatgacctggttgaagacatgctggccaacgtgggcatccagggccgccagggggtcatccagcaggtacacagctgcctttctgtatacagcccgggccaggctcagccgctgcttctggcctccggagagattcatgccctgtggccacaaaaggaacagtggcctgagtcagcatctacagggtgaaactggggtgcccaggctgtggcaggtcagggcacacctgcccatcagggtgaggtacagctcaacatgcctattccctggggacaggcccagcttccaaggcactcgctctcaagccaacaatgcctccatccttacccgacctcacttctccacttcccaagcacgcttcctggaggagttacctacacttcccaatccactctgtctcctcctgctcactctctctatctctttgagtccaactcttgtttccctttctccactgagaccaccatccatttccctattccctcatccagtggcagcttttcagtcctacttttgtattttaaattttaattgttttcttttagttttcattgatatgtaatagttgtaactattcgaggggcacaagtggtatttggatacctgtagggcagtggtccccagcctttttggcaccagggaccagttttgtagaagacgatttttccatggacctgggggcagggggatggcccgggggatggtttcaggacgattcaagcacattacgttgattgtgcacttctattattattattactgctgttgtcgttgttattattgagatggagttttgctcttgtcacccaggctgggagtgcaatggcatgatcttgactcactgcaacctctgcctcctgggttcaagcaattctcctgcctcagcctcctgagtagctggaattacaggcacccactaccacgcctggctagtttctgtatttttagtagagatggggtttcaccatggtggccaggctggtctcgaactcctgccctcaggtgatccgcccaccttggcctcccaaagtgctgggattacaggcgtgagccactgcgcccggcctacttgtattattattgcattgtaatatataatgactcaccatcatgcagtatcagtgggagccctgagcttgttttcctgaaactagatagtcccttctggggatgatgggaggcagtgacagatcatcaggcattagattctcataagatccctcacatgtgcagtttacagtagggtttgtgctcctatgagaatctaatgctgccactgatctgacaggaggtggagctcaggcggtgatgggaacaataaggaatggctgtaaatacagatgaaacctcactcgcctgccctctgcccacctcctgctgtgctgcctgcccagttcctaacaggccacagactggtgctgatccatggcccgggggttggggacccctgctgtagacaatatgtaatgatcaaatcagggtaactgagatagtcatcacctcaaatatttatcttttgtattgcgaacacaaccatccttctcttctagctatcttgaaatatacaagtaaatgatcattaactataatttcccttgtgcactattgattactttaacttattccttctatctaggccttcttgtctttcattcattcttttaaaacttatttttatttatttttgagatggagttccactctgacacccaggctggagtgcaatggcttgatctcggctcactgcaacctctgcctactgggttcaagcgattctcctgcctcagcctcccaagtagctgggattacaggtacgccaccatgcctggctaatttttgtatttttagtagagatggggcttcaccatgttggccaggctggtctcaaactcctgacctcaagcaaccctcccgccttggcttcccaaagtgctgggattacaggcatgagccaccgtacccagccattcattcattcttacattcagtcattccactaataaccactgcctcgttatcataaaccaggcatggttctaggctctggagaaacagcaatgagcaaaacaaagttgctgctctcttaatggatccatcattctcatgaaggggacagagacaggcaatccataaacaagtaaggcagacagcacatcaggtggaaagtgctatgaagaataaatagtaaagcagggggagccaggttcaggggctcacgcctgtaatcccagcactttgggaggcggagctgggtggatcacttgaggtcagaagttcaagaccagcctggccaacatggtgaaaccccatctctactaaaagtacaaaaaaaaattagccagttgtggtggtacatggctgtaattctagctactcatgaggctgaggtgggaggattgcttgaactactcatgaggctgaggtgggaggaatgcttgaactcaggaggtggaggttacagtgagccaagattgtgccactgcactccagcctgggcaacagagcgagactccgtctcagaaaaaaaaaaaaaaaaaaaaaaaagagaaaaagcaggtgcaggtgtagggtgcactaacaatagtagggtggctgtggtggtagataaggtggtcaggaaaggcctctctgtgaaggtgatagaagtgagggatgagccctggggactcctggggagagctttccagcagagggaacagcagtgcaaaggccctggggccagagtgtgctgtgggggatcagggaatatcacagagactaaggtggctgcagtaaagctgagaggtgatgatgggagatggggctaatggataccagagccaggtcacagggaccttgccagggattgtcatgacttgggctttgtctctgaggtaaatggggagatcacctgaggtccggagtttgagaccagcctggccaacatggtgaaaccctgtctctactaaaaatataaaaattagccaggtatggtggcatgtgcctgtaattccagctactcaggaggctgaggtgtgagaattgcttgaacgtgggaggcggaggttgcagtgagccgagattgcatcactgcatgccagcctgtgcaacagagcaagactctgtctccaaaacaaaacaaaaaacaaaaccacaagtggtgggctggatttggcttggggtcacagtttgccaacccctgcccaatccatagctccagatgcatatatcctgtttcttggacatctctgtccagaccccttggtgaggcccagagaggggaagcaattacaccaacattactcagcaaggcagggcagagtaagacaggagtctaggtcttctcactctcagttgtcagagagctcctcactgccaatccctgccacaactccctgcctctctctttgtgtctatttctgcttatcaattagtgattacgtattgagcacctagcacgtgcttgacgctgagctgagccctttttctccgctacttccctaaccattcctctcatttctccatcatactgcccatgatgagtcggggacccaaatgactcccaactgcaatgtctccctgtcccaaaaagacccccaaactctcacctgctccccaattgaagtgtggattccctcagggaagctgtccacatctggctgcagggcacaggcttctagtactctctccagccagggtgggtccagctcctgcccgaagcacacattctctaccacagaggtgttctgcacccaggcctcctggggcacgtaggccacagcaccctaaaacacaacttactttggtcacaggaggatgatggggacagaggtgggataggttttgaggagcagtgggagctgggctctcagtggtgggtgagaggtggagagaatgagtgaaagtgaacttggctgggatggggagggtgggaaggcagcgaggaagtgggactttcaggatggggacatcctagcagacaggctgggggtggcctcacctcgatgctcacgaacccctccacctttgacagctccccaaggagggcggacagcagggaggacttccctgcccccactggaccgacaacagccagcagacagccctggggcaccgtgaggtttattctggacacgcaagaggggagacatgaccttggttagggttcagcccgcctctgtgaggaaggatgagccccagacggagctgagctttcctgctctgggagtctccaagaggacctgtggggctgttctttttcccagtccttgtctagctatttgaggaactatcctgtgcacatctgtgcatgtacacatgcacacaaagcgtgcacacatgcatgcacatttgcacactcatacaagcatgctagcatgcacagcaacacaatgtgggcacgcatccacacacacacaagtgcatgcacatacccaatcaatccatgctcacacgcatacatgtgtgcacacatgcacaccacgcacacacacacagggttgactatagcctgagggtttcaccagcctggcctcctgccttggctcttgcgataaataggctctttcctccctccctcccgctactcttggtcccgccccactcctgtccacgtcccacagcccatcctccacccagtgaccagagggatctgttaaaacccaagtcagatcgtgacacttcccagctaaacccgccagcactcccatttcactcagggtcaaagctaaagtcctgacgatcaggaatgacatctcccgcctccttccgctctgtgcctcagctgctcggccctggccttgctgacctccttgctgtttcttgaacacaaaaggccagtggttctcaccagggggtgactgcatcccccaggagtcatttggcaagatctagagatatttttggatgtcacaaccagtagggggtgctgctggcatctagtgggtagagactggggtcagctaaacatcccacaatgcacacgacagcccccaacaaaggagtttcagcccaaaatatcaaccgtgctgaggttgagaaacccaggtccaggcactctcctgccccaggacctttgctgatgccattcccaccgcctagaaggttcttctcccaggccgggcacggtggctcatgcctgtaatcctagtcctttgggaactgaggcaggtggatcacttgaggtcaggagttggagaccagcctgacgaacatggtaaaacccatctctactaaaaatacaaaaattagctgggtgtggtagcatgcgcctgtaatcccagctactcgggaggctgaggcaggagaattgcttgaatccggaaggtggaggttgcagtgagccgagatcatgccattgcactccagcccgcgtgatagagcaagactccgtttcaaaaaaaaaaaaaaaaaaaaaaaaaaaaagaacagctcttctcccagacactccttccttatgatctcggcttgaatgcaaagccttccctcgctagacatgccatcgtactctgttcccttgctctggttttctgtttgggcctcacctctatcagcatgtcaccccacgagagcagggcccttgtctgtttccttcgccctatccccaatacctagaacagagcgtggcccatacctagtgctctatcgatgaagtgagtgaatgacaaccaatacaaatactacctggggcatattccttctcttcttagggagtttcagggctgtctgagatttttggccacaaagaccaagcgatagagttggagactatagatgatcatgacctcggactgatacaggaggcacagaagtgagcacagctgatagggctgaaccttggggctcctctcagccagccctcccttggcatcgtcttggccagcctgggagcacaggggtgtctccccctaatgggggaggctcagatgccctggtccccgtctgcaggagatactggtctatgctgtgcaggtccccaccttcaggaggtagagatgtatcctgagaacctccccggcagagccccagcccagccaaacccaccctccagtcccaggctggaaacctacaccacctctcaggtgggaggcagcaggagccccatgcatcttctccctaaaaacatgaggctggttactacgggtgtcgttctgtacctgtggaggcagggagggctttcctgggaccaggcgaaggtggcactgtgtatggtgatgcaatccttcccggcagctgcagggcacaagaggccatttacaggagacccctgacctggccggcctctgcatcggagaggcccccaggcaccatcccccgccccccccaggggcagaggctgcaggaagaaatctctcccactgaacaaattgccctgctactcactggcttgtgggtgaccccgcagggttcttgttctgtccgtgtcccatggctacataatccagggggaggcaaactgtggcccagagaccaaatcctgcctgctgccttttcttataaataaagttttattggaacacggccacatccattcatttctctatttcatgctttgagcagttgtgacagagactgtgtggcccacaggcctaaaatatgcacaatctggtcatttatggaaaaagttagtgaatttctgaaataaattatcatcaaatcccagccttcccagagtgaagggggtgttattaatttcactgtggccggcacagtgtctcatgcctgtaatcccagcactttaggaagcagaggtggtaggatcacttgaggtcaggagtttgagaccagcctggccaacatggcaaaaccctgcctctaccaaaaaatacaaaaattagccaggcgtggtggtgggcgcctgtaatcacagctacttgagaggctaaggcaggagaattgcttgaacccaggaggcggaggttgcagtgaaccaagattgcaccactgcactccagcctggatgacggagtaagactgtgtctcaaaaatactactgctactactactaattattattattatttcactgtgataacaagtgtaattagattagtggttcttgatccttaagacgtagttagaattgcctgaaagattttctaaaaatcaaagctctcatggcttagcccagatcaattaaattcatcgtcacaattagctgctataacgattaacatgcccattttggagatgggaacacggaagctcagagagatgatctacttgtcaggatcacccagctagtcagtgctggggctgggatttggacctgggcagttgaatgccacaggctcggcttcttaccactatgtgggtgttttccaggtacacagtttgcccaggttcttcagtgcaacaagggggagggtgtcttggcccgtggcataaaagaaggatggggtggagggggaagcccaggtaacttgagcttggtaagtctcatcgtgcaatggtgcttgaaatgctgctattttccagcttgatcaaaatgctgtcatgcttattacctgggactttctgcatgaggacaaggacctggtctgttagagcaggagtcctcaacccccaggccacagactggtaccagtctgcagcctcttaggaactgggccatacagcaggaggtgagcgcagggcaggtgagcagagtgtcatctgtgtttatagccactccccatcactcccatcaccgcctgagctccacctcctgccaaatcagcagcagcaatagattctcaaaggagcacgaacacttgtgaactgtgcatgtgaggaatctgggttgcgtgttccttataagaatctaatgcctgatgatctctgtctcccatcacccgctttggggccatctagttgacggaaagcaagctcagggctcccactggttctacgttatggtgagttgtataattatttcattatatagtacaatgtaataataataaagggcacaataaatggaatgtgtttgaatcatcccaaaaccacgcgcctctccccggtccgtgggaaaactgtcttccacaaaaccagtccctggtgccaaaaagcttggggaccactgtgttagagtgttccctgttgtacacccaggatggtacaaagtgggcgctcagtgagtggtcgctgaatggctagcagaaagaagagcagcacggtgccagtttccaagtgacacgcagatggcgtgatctgcacgtgtcatccattgcccgcagcccccatctccccccagtactgatgctggcttgccattatgggctggggtggcccccacatcccccatccctcccacacccctcctgccagactcagcactcaccgcttccagaggaacttgagtctacgacaccagggtcaacttcttccaggcagaggaaggtgaccagacggtcaaaggacacccgggcctaggaaaaccgaagccgcaggtcacccagcaagaagagcaaagaactcaggttttgggtgtcggtgtctcaagatgtgtggcaacagcttcctgtctaccaagctctgtgcataggaggcgtgaggacaaagctttctagttcatgggaaacgatgcaacccgagtggtgaccttgatggtggtgatctcccacctctgcgatcctacaaatcagtgacaccgaagcaagccagctgccattctgcagacaagatctgggaagaggatggtggcttttccaataaggttatcaagccattgtgtggaacaatttcaaatgttgtccacctgggggcgctctctcccagtcacaaacccatctttggggaagaaagagaccagtcgttaaaatagagattaggccaggtgcagcggctcatgccggtaatcccagcactttgggaagccaagtgcaggaggatcacttgaggccaggagttggagacctggggaacatagcaagactctttgtttctacaaaaaattaaaaaaattagccggatgtggtggcccatgcctgtagtcccagctactcaggaggctgggaggtagaagcatcacttgagtccaggagtttgagcatgcagtgagctgagatcgtgccactgcactccagcctgggtgacagagtgagacactgtctcaataaataaattaaataaataaataaataaataaataaataaataaataaggcggccaggcgcggtggctcatgcctgtaatcctagcactttgggaggctgaggcgggcttattacatgaggtcgggggttcaagaccagcctggcctggccaacatggtgaaaccctgtctctactaaaaacacaataaataaataaataagactgggtgcagtggctcatgtctgtaatcagcactttgggaggccaaggtgggcagatcacctgaggtcagcggttcaagacctgcctggccaacatggtgaaatctcatctctactaaaaatacaaaaaaaaaaaaaaaaattagctgggcatggttgtgcatgcctgtggtcccagctacttggcaggctggggcaggagaatcacttgaatctgcgaggtagatcttgcagtgagccgagattgcaccactgcactccagcctgggtgacagagtgagactccatctcaaataaataaataaataaaaataaaaaataaaaaacatggagatggctcaggtatgccgccgtttcttgttttcaccatgctgaaaggactagagatagcaaaggaagagaaacaaaatcgctttgtataaaaaagggaactgacatgattgcttgtatgtggaattgctgggcagatggacaagtatgcatgttctgaggtgtgtgtggaaaggtctgcacattgccctccaaaggctgaccccttccagatgtatttgctgtactctctgcccgcctctgttcttgcccctacccgcctcttttccagctccacaccatccctctccctcccactctgtcttccctctcctctgcaaatggcaggggtagggaagctggagccaggtgtagcccacgcactctcccaggatggctccagcccttgcacccacctcacctggacgagggagtggatggagaagggcaggaaagcctgggccttgttgaggatgttgagaactgtgagagtcacaaaggctttctctgcattcatagcattctcggccaccagagtgtggacagcaaacaccaccagtgcgacctggggggtgggggggacacgtggggcaacagtgagacacgcaagcatggatagggcagcctgggcaagctgtggtgcctgcacggtccatgtggcccacccgccatgtccgcatgtgcttccctccgtagatcccactcccagtcctgctaacacatgtcctctccgcagtcataagctacataaggctctctctaaagacacagcgcattgctaatggtgatgagtgcgcagccccacggctctaggcatcactagaacctaggggagaacctaatgcctctaggttccaggcatcgggggacagcagagtttttgatcttggtagccctgttgttctagacgtggtggaacttgtgattctagagtcccttggaagatgactctaaagttgcaggcaggagcagcacttgagggctctaggtgttggtgccatttgtggtgcttttttttttttttttgagatgaagtcttgctctgtcgcccaggctggagtacagtggcatgatctcggctcactgcaacctctgcctcctgggttcaagtgattctcctgcctcagactcccaagtagctgggattacaggcgcccgccactgcaaccagctaatttttgtatttttagtagagacagggtttcgccatgttggccaggctggtcttgaactcctgacctcaggtgatccacccacctcggcctcccaaagtattgggacgacaggcatgagccaccacacccagcctacgtatcaaattttttaaaactgtggtttaggaaggttgttctgacagcaatatgaaataaattacagaatggcaggacaaggatcacgtccagtgacagggtggctatggacatctgctggccaggatcagggaagtcactctgacccaggattctacctctgccacccccctgcatctgtaccctcctccccacatcggtagaagcctggaactctctctgagagttcagcagactttatcagccactgccacctttgctagaataatatgattaattagttcttgtagaagacagcagggacccagagagaacaggatccagaatgagtgggttttgatggacggggtggtaggatctggggggctccacctacctcaccctgcccccacccccgcactccttccccagtgctgctcagcatagagactagagtgacgtcaccagaaatgtagacacttggaaggacaccagcgacacagagaagaggaggccggaggtccgcaaggcgcccagctcctggcctcggatgcccaggactctgtccagaaaggctccctcccagccatggaacttgatggtcttcgagttcctgaggatagagctggtgagccgtgcccgtgagtccttctgcctcatttgctcctcctgggatcggagggaaaaagagagatgaagacagggacagttgagaactcttccctgcaccctgacagccacccttcagcaaatcccattcatctcaccaaactgcgtcccaaacctgtctgcctctcagcacctctgaccctcactcctggtccaaccaccatcatcctgtacctggacttctgcaggagtgcccctgggataatgtgccccatggaggaagcctctgatgcccggagaacagaggcagcctgagcccacctgggtatgacaccatcaggaaggctacctggaggtggttgatgcctgagctacgtctttttttttttttaccttttacattttttgtggagttggggtctcactatgttgcccaggttggcctcgagctcctgggctcaagtgatcctctgccctcagcctcctaaaatgctgggattacagcctgagctaaatcttaaatgaccaggaagtgcgtgctgagcaggcagaggatggggggatggagctggagaagagggaggggaggggcttgagatgggggtggggggtgggggctggggggtaggggggtggcgggggcacctaaaacccaggcacagggaatagcatgactcagaggacactcagtgtgaccagaggagcgtgtgggcagggtcacttggcactttaaagtcaggcagaagaattcagggtctcctgtgcttcaccatggggcggggggcatcatcagaggggcagctgcctggagaaggttttactttttgagaccgagtcttcctctgtcgcccaggctggagtgcagtggtgtggtctcggctcactgtaacctccgcctcctgggttcaagcgattctcctgcctgagcttcccgagtagctgggattacaggcgcccgccaccacgcccggctaaattttgtattttttgtggaggcagggttatgccatgttggccaggctggttttgaactcctgacctcaggtgatctgcctgcctcggcctcccaaagtgctgggattacaggtgtggcctcccaaagtgctgggattacaggtgtcagccactgtgcccagcctagaatgttttagaggagtccacgcaggaggctgaagaaacagcccaggtgacagacggacactgggacagctgggccaagagaggaaataagttccttccctccatcccccatctctccctctctctttcccgccttttctttccttccttccctatctcctttcttcctctttcctttgctttcttccctctttccttttatttccttccctccctcccccctttcttccttctctccctcattccttctcttccgccctcaattctttccttccctccttccctctgtccttcctcccctttcctatctttccttccctccctccttttctctccttcccctccctccttcctctcctcctttccttcttccctccctcctttcttccatagttcacaaacacttactgagaaccttctgcctgccaagcactaactagatgccgagttggccacaatcagtggcctgtgctgttgcaaagcttccagttaaggaaaacaaggcaatcaaccctgccgggtgcttcctgtaggaccctgtaggttgtgggaagtgctgtggggggaaaaaagcaaaaacaatcccagggcaggcaaaggagaggctgctgctgggaggggagggatggacgtgccatttccttgctggagggtggtgagggaagccgccctgactgcagggaggtgacagaggatcttcgggagtgagggtgatccaggtggagggaacagctaaagcgaaggcctgcagggatgtgtgagatcgggcaggtttgaggatgggagatgtgtggggaaaggcagggaaggaggggagatgggtagaaggtgaggttggaagcaataaggccagctcagggcgggcctggtgggccactgtggggtctttggctcagtctgaggaaaatggggccgctgtgggtctgagtagaggaggggtacaacgtatttggtttgcataggtctcctctggctgggagtggagagaggctgagggcagaggcggggagtgagccaggggcttgctgctgtgacctgggttagagatcatggggttcggagagcctatgctgggaagtgtgacattttggatgcattttgaaggtgatgccaagcaaatctgctgacagatgggatgtgagagaaaaaggcattgaactgacccagggcctgtggcctgaacattggagggacggagccactgtccattgagaggatagggggagggggtgcaggtctgagtgatgggcagctcacagacgacaagaacaaagccagacccgtgggctcgcactcagctctcccctccgcatctcccacaccaggacctgtggcttcctccctacttcctgcctggtccgtccctttcccaaaagccaaacctgatggtggttccttttcttggagatgaagaaattcagagggaggaggctcaggaagacagcgatggcagtgagggcggagggccccaggagctggggatagaaggggcaggatgtcaggagatcccgaggagcccagctctcagaggcacgtgaaccagagcaactccatcttgaatagggactgggtaaaatgaggctgagacctactgggctgcattcccagacggttagggtattgtaagtcacaggatgagataggaggtcggcacaagatacaggtcacaaagaccttcctgataaaacaggttgcagtaaagaaggcggccaaatcccaccaaaaccaagatggctacgagagtgacctcccgtcatcctcactgctacactccaccagcgccatgacagtttacaaatgccatggcaacatcaggaagttaccctatatggtctaagaaggaaaggcatgaataatccaccccttgtttagcatatcatcaagaaataaccataaaaatgggcaaccagcagccctctgggttgctctctctatggagtagccattcttttagatctttactttactaaaaaacttgcttttggccgggcacggtggatcatgcctgtaataccagcactttgggaggccggaggcgggcagatcacctgaggtcaggagtttgagaccagcctggccaacatagtgaaacacagtctctactaaaaatataaaaactagccaggtgtggtggtgggcacctgtgatcccagctactcgagaggctgaggcaggagaatagcttgaacccaggaggcggagcttacagtgagccacgatcgcaccactgcactccagcctgggtggcagagtgagactccgtctcaaaaaacaaacaaacaaacacttgctttcactttatggactcgccctgaattctttcttgcacgagatccaagaaccctcttttgggatctggatcaggaccccttttctgtaacacagctgcagaccccgaaggtggtcagacttgggtcctaagatggggatgtcagggaatctgataagggcagccaccaggtcccagggatctgtgctcatggggtctgctgtgtcaggagatgcctgctgaaggtggggtccttcaatgtcagggagggaaacagccctcttacacgatagggagagagttatattcaagacagattgtgcacacacacgagtgggactggggggtgttcccagccacaacagtaaagttgagacctatggaatcaggggacctggttcaaatcctgaccctgagagttttgagtgtggccttggggcaagtcatctcccttaggtgcaattctcttgtctgcaaaatgggaatagagttgttctcatttggcattttctcttattgcgtttaattattttcctaatcttcatttcatccctcgcaagggttgtcagatttagtaaatcatcatacagaatgcccagttacatttgaagataaagagtgaataaggttttagtctaagtctcgtgaaatatttgggacatacactgagaaattcttccgtttgtctgaaactcacacttcactgaatgtcctgtgttttctctggcaaccctgctcccccaccaacgtggtgattttgggatggttatcttccccctctcggctttggtttctatatctggaaaatgtggaagtggggggtagaataaatgatttttaagttgctgtgactttctgagatttctgcacaggttatttggacccattctcttgacaagccccaccccaactccagtctgtgtgcctcagtttcccgtctcagtccttaggaacactatgtttatttatttatttatttgtttgtttattttgagatggattcttgttctgtgacccaggctggagtgcagtctcatgatcttggctcactgcaacctctgcttcccaagcgattctcctgtctcagcctcctgagtagctgggattacaggcatgtgtcactcggctaatttttgtatttttagtagagatggggtttcaccacgttgcccaggctggtctcgaactcctggcctcaagtgatccacccacctcagcctcccaaagtgctgatattacaggtttgagccaccccacctggcctgggaacactattttctaacattgggccagtttgtttcatttatgcggcaatggcgctacctagtggctcaatggagaagggcgcagagggtaaacaccagcccacagcagggcttggaaaaacactcaaggaatgtgagcagaagatgaacatctctgtctgggggaaaaatggtatcattaaactgtagcaacctcagtgtccactcctccttcaccaagacctcacggtgatgttaggaactgtctaccaagaggcaggaaaagtacacaagcaaagtaacatggtgcattatctatggatatcttgttggtctcatctaattttttttttttttttttttttttttttagaaggagtctcactctgtcgtccaggctgcagtgcagtgatgtgatctcagctcactgcaacctccacctcccgggttcaagtgattctcctgcctcagcctctctagtagctgggattacaggcacatgccaccatgcccggctaatttttatattttcagtagagacagggttttgccatgttggccaggctggtcttgaactcctgacctcaagtgttctgccggccttcacctcccaaagtgctgggattacaggcgtgagccaccgtgccccgcctggtctcatctgatttttagcaacggtggggtcaacctgatcaattgccctgaattttcccatgttcttcctctctccctctctttcttcctaatgatgacatttatgtactgcacatgaagccctgtctgagtgccttatgttgtaattgctaagcacctgcctattgtttgcaaggccctggaatacaaggtgaagacactggaaaaagtcctggcccctagccttagcaaaaacaatcatatgcatgagcattcgagttttttttggaatattcagcaattacaatcaaaatgccattaacagtttttacaaggccaggcacagtggctcatgcccgtaatcccagcactttgggaggctgaggtgggcagatcacctgaggtcaggagttcaggaccagcccagccaacatggtgaaacccagtttctactaaaaatacaaaaattagccagatgttgtggtgcacgcctgtaatcccagctactcaggaggctgaggctggataattgcttgaacctgggaggtggaggttgcagtgagccgaagttgtgccattgcaccaaagcctgggcaacacagtgagactctgtctcaaaaaaaaaaaaaaaatcaaaaggatactatttcacgacatatgaaaatgatatgcacttcaaatgtcagcatccataaatagagttttattggaggaataccatgcctgtttgcttagtatggtctacagccacttctgcactccaagggcagagatgaatatttgcaggagagatggtgtggcctccagtgtaaaaagcatctactgtcttatcctttatggaaaagtaactaatgataatattacaaatacctacagggtgcagttgtgtgcccggcacccttttaagtgctttctacatatgggctcgtttaatgcctcagcccctctggggcaggagtgctactgttaattatgatcctcacgttggagacaagaacaggaggcacagagagagtagggtccttgcacacagattcacaactgataagtggtcagaaggaggatttgagcctaggcagttcccgatacagagtctaattttatttttacttttatttatttgttggagacagagtctcactctgtcacccaggctggagtgcagtggcattatctcagctcactgcaacttccacctccaaggctcaagcgattctcctgcctcagcctcctgagtggatggggttataggcacccaccactatgcccggctaatttttgtatctttcagtagagacggggttggccaggctggtctggaactcctggcctcaagtgatccacctacctcaccccccaaattgctgagattataggcatgagccactgtgcctggcccagagtctgattttaatttaaaaaaagaaaatcctataccacaacgttaaaggaatgaagttggaaagtaaatgttttgtttgttttgtttggttgtttcctgatggctactttgtgttttttgaacactaagtagcaatttttccccctaaaatgttctcctcttgtgttttgtggacagtggctatggtggtgcctcagggttactggtaacttcaaaacatggttaacttgcctactgggtaccctaatagcacatggggaagtatcaacgtcatcatcatcatctttctacagaggaaactgaggcccagagagggtgaacttcctgcccaaggtcaagtgaaggtcatccttattgaggacttttcccatcgtatcagacaatagtaggcaaattgagacaggattggaggaggaggagaaggaggagatgggggtggaaggggaggagaaaaaggaggagaggaagaagaaagggaagagaaggagagggaagagcagagggaagagagggaggacggtagaggagaagaagggagaagggaagaagtgggagggaagatgacagggagcagaaaggaagaagaaggtggagcaggagagaggaagaggaggaggagggggaaggaggaaaaggaaggggtgcaggaagaggagggggtgcgtgggcagaaggtgggagagatgcaggaggagggagggtgcagggaggggtgcaagaggaggggggcaggaggaggaggctggggcagagggagaggggaggaagccttatgagcttctacaccaggaatggaatccagggtgatgaaggcagaacaagggtaaaacctttcatgtgcctctctgacaccaacctggttctcccacagcctcagacttgccctaaccctggggtcacagcggacctcttccagcctcttgaatgctaagtcaggaggaggaagggtgggagggggaaggaggagggggagaaggagggggtgggggactccgttcaaatcccgtcttcctcctctggcatacctgccagagatagacgaagcagaccacgatccagacgagaggcagccacagcccgttgaggtagaggacgctctcggtcagccgctgcacgtccacggacaccagattgaccacatcacccaccgcactggcctttctggagccgctggacagagccaggacctggcgggtgggcagaaggagagaagtaaagtggggaggccggggcagagggatgccccaggtggcttctccacccactgagccccacctcacacgtctgcgaggtgggtgagtaaagtctcttaggccaacctctcagggctctttgaggatccacagagatgacaaaaatgaaaatcctccaagatccctaaagcacgggaggcataataatgaataacatgcacgaaaacaccagattaacacagataacggtggtcatctgcccagtgctcaccatgtcgcaggcactgtgctaaatgaacagccttatcctttcccggggtgctcacagccatgaatggtaccaagcaggcactaccatattcattccctctaatgccaggccaggtgcagtggcctctgcctgtaatcccgccactctgggaggctgaggtgggaggattgcttgatcccaggagttcgaaaccagcccgcgcgacatagtaagacccaagctctacaaaatactttaaaaaattagccagggggccgggtgcggtgcctcacgtctataatcccagcactttgggaggccgaggtggacagatcacctgaggtcaggaggtggagaccagcctggccaacatggtgaaaccctgtctctaccaaaaatacaaaaattagctgggcatggtggcaggcacctgtaatcccagctacttgggaggctgaggcaagagaatcgcttaaacccaggaggcagaggttgcagtgagcccagatcaagccattgcattccagtctgggcaacaagagcaaaatccatttcgggggggaaaaaagaaaaaattagccaggcatggttgtggtgcgcctgtggtcctagctagctactggggaggctgaggtgggaggattaattgagtacaggaggttgaggctgcagtgagccatgttggtgccactgcactctagcctgggcaacagagcaagaccctgtctttaaaaaaaattctatggataaattgctctctattattctctcaccaaggaaaataccacttccagttaaattaagacatgtaagagacatctcgattttggaagtattagagtgaaaaaaaaatgtgagacgagaatcaatgaaatgaacatttactaaccccattctatggctaaagaaactgaggcagagagaagttgagcaacttgcccaaagtcacaggccttgtaagctcctacacaaggaatggaatccagggtgacgaaggcatgacaagggtgagacctttcatgtgcttctgtgacaccaacctggttctctggcagcctcacatctgccttaaccctggggtcacagtggacctcttccagcctgttgaatgctaaattccaaatgcagccctccctttgtgactgcgtgagggtgtgaagaagtgatccaggaatgactggacatagaaattctccacttagcaagtctttgaagagtgctcactgtgtgactcacactgagctgggaactgaaaatacagctgtgaacaacagagatgaggcttgctctcccgggcctggagtttgaggtggggaacaaggctctataataaagatttatataactggccgggcacagtggctcacacctgtaatcccagcactttgggaggctgaggcgggtggattgcttgaggccgggagttcgagatcagcctggccaatatggcaaaaccccatctctagtaaaaatacaaaaattaactgggcatgctggtgggcacctgtaatcccagctatttgggagggtgaggcaggacaattgcttgaacccaggaggcagaggttgcagtgagccaagattgcaccgctgcactacagcctgggtgacagagtgagactctgtctcaaaaaaataagacaaaacaaaaatatttctaaaactcatgctttaatggcagttatgatgagtaacataaaaaagtagcccaggctgagcgcgttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtcagaaaaaaaaaaaaaaaaaaaagcccagaggttagagaggagggatctgatctcatcaggagatcaaagaaggcctcctggcgtgtgggtggggaataggaagatcaatgcctgctcaccaggcggccttcctcttaggctcaaggaaatgtggactctcaagacaggatagggcacacctagctctggcatgctcaggggaacaggagcctgggatgcagcactctggcaggaaagcatcaagagctgccctctcggccacctaggagctgtcccctctgtcccctcctcccctaggtgacagctcaggtgtcagggaatgacacttacatgggacgggacctgccctggctcagatgctccataccccacaggagccaatagctcttggggcagcagtccagggacttagcttccagagtcccaggaacggacaagagccactgcacagagagaagtctaaagctatggcctccaaccaggtattcacagtcaatggacagaacttccagcccagatgcaatttgggtttttttgttttgttttttttttgttctgagacgaggtctcgctctcttacccaggctgcgctgtagtggcgtgatctcagttcactgcaacctccacctcccgggttcaagcgattctcctgtgtcagcttcccaagtagctggaattacaggcacatgccaccatgcctggctaatttttgtatttttagtagagatggggtttcgccatgttggccaggctggtcttgaactcctgacctcaagtgatccgcctgtctcagcctcccaaattgctggaattacaggcgtgcaccactgtgcccagcctaggggtcatttttaccccaagcagtattgtctgggaacacagctgacaggccaccttatcagaaggttaatcctttatcctcaagggggaatgagtggaagttaaaatcaggctcaaaaattaaaattagattgggggagtagaagtggtgcctagacagtgagaacagctgcaaaggccccagggtgggtgggggcctggagtgtttgaggaactgaaaggagacctgtgtggctggaggagagtgagcatgggaggaggtgacgggatgaggtcagagacaccctagggacagatcacacaagaccttacaggaataactaaggagctgagacagatcacttgaggctaggagttcgagaccagcctgaccaacatggcaaaaccttgtctctaccaaaaatataaaaattagctgggcgtggtgacacgtgtctatagtcccagttactcaggaggctgaggcaggagaatcacttgaacccgggaggcggaggttgcagtgagccgagattgcaccactgcactccagcctgggtgacagagcaagactccatctcaaaaaaataaatacatataatacagagaaataactaaggaagtgagaatgtatggtgagtgactctaataagcaaggactgaatgcgttctcagctgctgataacattactgcccgctcagtgatactgcttttcctggctgggaagacctgcccttgtcccccagggctcacctttctgtacaccaggccagtgatggccgaccgcaacctcatctgcagcaccttgagcctgtacatgttctgctgctcaaacagcgtttgcaggcaggctgagaggaacatcagcacggcgaggaggtagcccttccaggctggaggcttgggatcaccaataaactccaggaaaaggcttgcaggggaaggagggagaaggtacagctggtgagaggaggtgcctaagggtgttgcctttgcccaaaccagtccagatgtggaggatcagtcggcccaaactagtccaggtgtggaggatcagtcagtgtggttttttttgcaataatggtctccgttatttcccccactgtccatactccttttcaatctgactgcagctcctcaagatcaagaggtggagtttttgttcccacttgttataggctaaattgtgtcctcacaaagtttatatgttgaagccccgacccccagtacctctgaatgtgactgtatttggaaatagggcctttaaagaggcaatgaagttaaaaatgaggtcattaggctgggccctaatccaatctgatggggtccttttaagaagaggaaatgtagacacacaaggagacaccagggggcgcaaacagaggaaagaccatatggggacacagggaggaggtggccaactgcaagccaaggacagaggcctcagatggaaccaccttgcagatactaatctcgaacttccagctttgagaatcatgataaaatacatttctgttgttcaagccactcagtctcagtctgtgatgctttgttatgtcagctgagcagacaccacttgaatctgggctggctacaaaaccggctttggccaacagagtacagtggaggtaaagccatgctggctctgagcctaggcctcaagagaaaatgtggtttttggtctatttcttagaaccctcccaagcacccacatgaacaagtctgagctagccttttggaggatggggacccacatggagcagagacagccatcccagtctcagatacacaactgcaggcacatgagaaaacccagccaagaaaagaaccaccacccagctgagcccagcccacattactgacccacattaccatgaactaaataaaagaatgtttgtcattttaagccactcacttttggggcattttacagcaaaaactaattgatgcagtcaggtaagagcttgcttatttgcccttctgggggtcagtcactttctcattaatccatttcccttcctcagtgtccttctcacccaccatccagtgtcccgagcaccagacgtataggcagaggcaggagagctgaagccccctggccctggaaggatgccactaagagaccacccaccttagcagggcacttgaggtctgggactcacctgagcagcttggggacagtgaacctgaagacatcactgatgatgaggctgagggtccccaggaggaaggtagaatggaacacctgccagatggccttcagcagtgggcgccactggctcccttcttgccgtaggaagggctcggtctctggagccttcatgccactgccgcctttccttttaaatgctattgccttgttgtgcctgaggggaagggagagattagctctgggtcccattttatactctcagccgccagcggcagggccaggcattaaagggttgttttcccaacagtggagatgggtgggtgtggatctagcctggctccctcacctgttcctccttatcaccctgagtacccacttaagaggcaatcatgggagttggggggcagggcaggagggcactctgaggcctcttagatggccatgggaaagcacacctgttgagcacctactatgtgccaggcactccccagtcatcctaagaccccctgagaagccaggtgttgttcccatttcacagatgagaaaactggggctcagagaagcgaacttgcccaagggcacacagctgagaagtaaaagaactggaatttgattccagctctctgcctccagagcccatgcacttttcttttttcttttcctttttttttttttgagacgaagtcttgctctgtcgcccaggctggagtgcagtggtgtgatctcagctcacggcaacctccacttcccagttcaagtgattgtcccacctcagcctctcgagtagctgggattacaggcaagtgccaccatacccagctaatttttgtattttcagtagagaaggggttatgccatgttggccaggttggttttgaactcctgacctgaggtgatctgctcgccttggcctcccaaagtgctgggattacagatgtgagccaccacacctggcctctcatgtacttttcaacctatcgtgttgtcaacctggaggaagaacagcaccccgtccccaacacacacaatcagccagcccttaggtggttttgaactggtggagaatcacggctgatgggcatggggcctggtgctctagctctgggtgaaagtgcagacagaagctcaggctgcctcaaactaataagatccccagcctttggctataaccaggggccacagagaagagctaaggtgagggagggagaggaggagatgggggaggcccgagggcccctgtgaggcaggtcagaagccctgggccagaaaggagaggctggggcgatgcagctgctgacagtccggttgctgtgtggtcctgggcggggacactgctcctctctctgtgtgtgagaggatgggtgtggtcccctgctgagtcccctgtggctctgacaacctataaggttatcagtaatttctttttctttttcttttctttttttttttttttgagacagagtttcgctcttgtcgcccaggctggagtgcagtgtagcaatctcggctcaccgcaacctctgcctcctgggttcaagcaattctcctgcctcagcctcccaagtagctgggattacaggcacacaccaccatgcctggctaatttttgtatttttggtagagacagggtttcacaacgttagccaggctggtcttaaactcctgacctcaggtgatccacctgcctcggcctcccaaagtgctgggattacaggtgtgagccaccatgcccggccacttatcagtaatttcaatccccattacagatctgtgacccggggccacgtgctgggatcagctctttacacgaaggagctcactgactcccctggatccccttgccaggtgagcattattaggttttccattttacagaaggggaagctgaggctctgagagatggcgacagccgcccgaggtcacacagcaagggcagagcagggatttgagcctagatcttgatttatggtttgtaaagggtttcttgtgcactaaggacccccaacctcaccataataaaataataataaaaaaagaagcataagaaaaacctctggtgagctcaggtggccagacccttcaaggccaaggtctctgtcccacattattggtctgatctggtgtttggtttggcatctatggagggttgtggttcagctctgttactgagtgggtgtggcctgctgctcacaaatattttggcatttggatctcaaagccaagaagatgccccttccatacagagagcatccctgcccaccctttcctgtttgatcctgccatttaattcattgccttcacagccatgtccatggctccaaccctctctttgtctcgttagaaccccaggtgggtagactttgcctgtgttttccaccaagatgtccctagtatagagtccagctcctgcacacagtaggagctcaataaacacttgtcaaatgaatgggaaaaacagattgagtgatgtgtgcaaagggcctaataagagtgccccctgcacatactgttataaaaatttatagaaggaaggaaggagcttggctgggtggacagaacttggctttggagccaggagactgtggttccaatgcctgctctgtctcctctcctctgagccttagtgtttccatctgcaaaatggggtcggggaagagttcactggaaagttttctttctggctgaggttctgctcagttctatttgagctgtttaacccagagagtcagtgtgttcagcctgcaggctccatagcaagtgttttcctctcctgcaggtctcacctcccatcaaggaagatgtccagattgctgtctgacgtctggtctctggactgaaggccatttagtgcagatctcacaaatgatggtggggcaaggcagggggtatgcatgagtggcatgggcaaggtgtgagttgggggatacaaaagggagtggtggaggccgggcacggtggctcacacctgtaatcccagcactttgggaggccaatgcgggcgaatcacctgaggtcaggagttcagggccagtctgatagcctgagcaacatggagaaaccccgcctctaataaaaaatacaaaaattagtgaagccgactggaccagcaggtggctgttgtgtggcctctcaggaggacgccctctcccttcccccagtggttgcaaaatacttcagaaagaaaaccaaagttctctgtgggtgcagtcggttgtttcagaagctgacggagcctggtctttgtataaccccatctttcccctttctttctgtcaactgtttatgggaggattctcaaactgttctggagaatgtttctaccctttagttctagtgttgggtgacctgtaattttcatgttggctggggatgccaggagttggcagaggctccttccagagcccctgtggactggattctgccacttccgtaaaatcattcaaaagtagagggtgagtcaggtgcagtagctcacatctgtaatcccagcaccttgagaggccaaggcaggcagatcccctgaggtcaggagttcaagatcaccctggccaacatggtgagaccctgtctctactaaaaaaaatttaaaaatcagctagatgtggtggcacacgcctgtggtcccagctactcagaaggctgaggcaggagaattgcttgaacccaggaggtggaggttgcagtgagctgagatcataccacaacccagtgaagggggtccagcaagccatgcctggggtgagagagaactgatgttttggttctctcacactacttattctgtttggaaaaacacatgcccttcctttgtgggaacagcccctacccacttctgtggctctgaagggaccaccagtcatggcaccagccccctgggcatgggattggcccctgacaggcacatgacttgagccaggccaattagaggccttccttgggatttactatatggacgttaggagagagatgctctcttattctgctggagtttgctgaacttgcatgggaagggataggccttatggagagaccaacacatagataatagttgggatgggagatgaaaggagagaatcctgacatcatttgagtcccctgatccagcaacacctgaggctagatcctcttagctgtgtgagcctatagtatcagtctctgtctcctctgtctctcttaatgtgtgggattcagccatctgcaacaactaccacaaaatcccggagtatgcagggaacttcccacagagctaacttccttttttgttctgtctcctaaaacaccaagatccggtgaggttaagcaacgtgtccaaggtcatcactatttgaaggcagggcagcatttaacccaattttatctaatcctatgcaggctcatttatctagaccagagtttctcaaatgaggcatcccaggctctaagggctgcagagaagtttccagagatgccactgagggcaggagtggacagagtggataactccaaagatcttaacaccctctggatgactaacagtgcttgagcacttcccatttgcaagacatttgcaagttcttttccataaatcatccttttttttcatccccataagctatgagctggggctaatgacatccccactgaacagatgagaaaactgaggcccaggaaaggaattgctcaggttatatagtaagtgagcagctgcttgtgtgttgagtcacctcccaaccctccaccccggccttaaaatacctcttctgtttgctgcctgtcattctgccatttccccatttgtaggaacctgtttgttccccgtttgtaggaacctgtgatgcgttctgggaggaaccatatcttaagcctgatactacttagtgggatcagctggaaggcaaggtggggaggcggcagtgccgccagagtagcgttgggggctggactgggggtcaaatgatgaggtttttttgtttttgtttttgtttttgtcttgtttgtttgtttttttttttgatacggagtctggccctgtcactcaggctggagtgcaatggtgacatctccactcactgcaacctctgcctcctgggttcaaacgattctcctgcctcaagcctcctgagtagctgggattataggtgcctaccaccacgcccagctaatttttctatttttagcagagatggggtttcactatgttggccagattggtcttgaactcctgaccttgtgatccgcctgcctcggcctcccaaaatgccgggattacagtcgtgagccaccgcacccggccaatgatgagcttttctgaagtagcatcaggtgagttcttgacctccacccacttacctccgggctgcactgcggttcctcatccactccttttcaagccgggaaacaagttcttctgaggagttttctctcccaagcgaccagaggtcttttggtctcagtggcctcctgtatcccctccagaccaggctgcaaaagaggggcaccagggaaagcttttcctgccattcacccctgcaggatcctggccaggcgagtagctgtgtgaccctgggtaagtcactttacctctctgtacctctactggcccctgggtaaaaagaaagcaattcactaaccccacctaatgtctgcagggcatttctcgtttcacaaagattgtctcattaattcttacatgaacccataaggtaggttattattgtttgtttgagatggagtcttgttctgtctcccaggctggagtgcagtggtgcaatctcggctcactgcaacctccacctcccaggttcaagcgattctcccacctcagcctcctgagtagctgggattacaggcacccaccaccatacccggctaatttttgtattttttgtagagatggagtttcaccatgttggccagactggtctcgaactcctgacctcaggtgatccacctgcctcagcctcccaaagtgctgggattacaggcatgagccaccacacccagcctgtaaattgatagtttataattgtataaatgtatgagtatattattatagatctattttacagatggggaaggaaatagaagtgcagagagattcagtggctaaaccaagggatagcccttggcaagggaaacagacatttccctgggaatcagaagtccgttgaccaaaactatcattgtagaagaagcttgaactcctccctcagctttttttttttaattattattattttttttgagatggagtctcactctgttgcctaggctggagtgcactgatgtgatctgggctcactgcaacctccgcctccctggctcaagcgattctcacgcctcagccttctgagtagttgaaattacaagccaccatcacacctggctaatttttgtgtttttggatggtgtatcaccatgctggccaggctggtctcgacctactggcctcaagcaatcctcccacctcagcctcccaaagtgctaggactacaggcgtaagccaccacacctggctaatttttttgtttatagtagagatgggatttcgccatgttggccaggctggtctcgaactcccggcctcaagtgatctgtcagggttggccttccaaagtgttgggattatgggtgtgagccactgtgcctggcctcaggtctctttaatctttctgatgacaccagccagaaggtcttgcctggttctggtctctgactcttctctaagccttaccaagttcccttttcttttttatttttattctttttatttttttgagatggaatctcactctgttgctcaggctggagtgcactggtgtgatctcggctcaccgcaacctccacctcctgggttcaagtgattctcctgcctcagcctcctgagtgactgggattgcaggctcccaccaccacacctggctaatttttatatttttagtagagatggggtttcaccatgttggtcaggctggtctcgaaatcctgacctcaggtgatccacctgcctcagcctcccaaggtgttgggattataggcgtgagccactgcgccaggccaccaagttcccttttctaatgcagagccaacttggggaagcaaccgttctgacatagaaattattaacgtggcttgattttccctgaaattatttttggagttctcctatatggcaagtgatgctatagatttttcctattttagcagtgatagagagtttctttttaaaaacagtttattcgagtaaaaaaagtgactcaatttagtttttgccccagtaggacaaaaaagcatcaagagtggtccataaatgcttaagtttgggaagcaggggctggaccccccagtagagctgtttcgaaaacctctaagctctttctaccagttccacacattcaaagcctgatatttttcatttatttaatagccatttaggccgggtgcggtggcttatgcctgtaatcccagcactttgggaggtcgagtggggtagatcacttgaggtcaggagtttgagaccagcttggccaacgtggtgaaacccggtctctacaaaaaactacaaaaattagctgggcatgatggcaggcgcctgtaatcccagctgctcgggaggctgaggcaggagaattgcttgaacctgggaggtggaggttgcagtgagctgagattgtgccattgcactgcagcctgggcaacaagagtgaaactctgtctcaaaaaaaaaaagagaaaatgaatagcccaggcacagtgggtcacacctgtaatcccagcactttgggaagccgaggcgggcagatcacctgaggtcgggagtttcagatcagcctgaccaacatggagaaacactgtctctactaaaaatacaaaattagccgagcatagtggtgcatgcctgtaatctcagctactcgggaggctgaggcaggagaatcgcttgaacccaggaggcggaggttgcagtgagccaagatagtgccattgtactccagcctgggcaacaagaacggaactccatctcaaaagaaaaaaaaataattaccacttaaactcattatttgccaggccctgttctaagtgctttacagatctcatcttatttaagcttcacaaccctatgagctaagtgctactatcaatcccattttgaaggagtggagactgaggcacagagaggttaagtaactgtccaaagcaacacagctaggaagtggtagggccaggattcaaatccatatgtcaggtgctactgaggtctgaatgccgtgtggttaggagagagcacatcctcaagtgccttgtgagctggccctggagaagcagctgttttctcaatctgcctggaaccctctagaaagtagacacttgctcctttatctcctcacccctggggcttagcacatagtaggtgcctattaaatgttggtggaatgactgaaatcaagtattggagacaattctaattactattaagcacccgctgtgtgcaagcactaagcactttccgtctcatgcaggttgagtcatccccattttacagagggaaaactgagactccggaggtttgcgacatggcctgctaacaggcagagccgggattcaaatcaagatctcactccagtgagtgaatgggaacaggatgcagatggtagacactgaacacgaagaagaaagcactgaggctgggatgaagaaagacttgctggcctttgtaagcacaggggaagggccatggctgggaatcagagcagcaaatgcaggcgggtgaggcaccaccccaacccttccgtgcgactttacttacccagaaacccaccagaacgtggctttggaggggaaggctgccccagtctctggacaggggttctgcaacagacaaaaatggagaagggaagtatgtggcaagggtaggaagacaggacgaactgtgtatttttttttttttcgagacagggtttcgctctgttgcccaggccagagtacagcggtgtgatcttggctcactactacctctgcctcctgggttcaagcgattctcctgcctcagccttccaaagagctgggatgacaggtgtgcgccaccacacacagctaattttttgtgtttttagtagagacagggtttcaccatgttggccaggctggtctcaaactcctaacctcaagtgatctgcctatctcggcctcccaaagtgctgggattacaggcatgagccactacacccagccctgacggtgtatttagtactgaaagtaaacatcgaggtgccctgtctccttgccaggggtgtagaccagtgagcttggtgcttcccagcaggcagcgtaaaaagaggttgggccacaggcctgacaatgtccacaaggtaagaaataacagtggctcagaagaacaactatgattatactgaaaccaaaaccttgctttgcttctcaaaaggaaggacactgcataacgaagaaattagatccttgacaatatccctcggcaaatgttgtgaagacagacctgtcgtgcgatttttgtcaggtgctccaggaagattacaacagtctgtactctttaccaataaggcgtgaaggtgcccatttcaccacgtttttgccatcacagcttattaatttttaaattttgttgctactctggtaggtacaaaaaagattcctatgatagttttaactattctcaagccttcgagcaatttttttttttttttttttgaatacagggtctcgctctgtcacccaggctggagtgcaatggtgcaatcatagctcactgcagcctttatctcttggattcaagcaatcctcctgctttagtctccacagagctactctgtagtgggactacaggcatgcaccaccacactaggctatttttaaaaacctttttgtagagatggggtctcactacattgcctagtctgatctagaacacctgggcacaaacaatcctccttcctcggtctcccaaagtgttgagattacaggcatgatccactgcatctggccccatttgaacatctgtttatatgatgtcagatcagtctcttccacaaaagaattgtttcttgatttcacagactgcttcactgttacctattgtaaatctctcaatctctcatgagcttcttctatggagcacttaccccaagggtaattttctttttccttctttttttttttttttttttttggtggagttccgctcttgttgcccaggctggagtgcaaatgcacagtcttggctccctgcaacctccacatcccggattcaagcaattctcctgcctcagcctcccgagtagctgggattacaggcgtgcaccaccatgcctggctaatttttgtaattttagaagagatgaggctttaccatgttggccaggctggctttgaactctcgacctcaagtgatccacctgccttggcctcccaaagtgttgggattacaggcatgagccactgtgaccatccaattttcaacatatttgtttaattttgtgaccagtgtctggttcccctgcttgaccagtagctacgtgagaacagaaactctatctgcttgttcaccatagatccttatgcccttgctagggcatagcggggtttggcaaactatgaccaaatctggcccactgcctgtttctgcaaatagtgttattgcaacacagccatgcaatttgttgacatattctgcttttgcgttcaatggcagagttgagtaattgccactgagatcactgtatggctcacagagtccaaaatattttctcttggcccatatagaaaaagtctgccaactgtggcatcgagtagaaatgtggtacactttttgctgaatggctaaatgaataaaaaaattaaagacttttggtcacctgggggagactgagacctcaaagtggaacaggaatgaggttggaacttggtgacttacagactgctgggggtcttcagggaagaaggggggttgatccgccaggcaggacagcacaaactgtgccaccaccagagacaggcataggtaggtggacaggtggcggacagggtcgctctggaagccctgtgggagggaaagcagaagataaggaatggagacagaggagggtgctcagaggagagaaaaggtttctgatcttgggtcagtgcccactctggggaccagggcaagagtatttgaaagccagagccctggctttcctagtggttctaattttctttctttcttttttttttaagacaaagtctcacttggtcgcccaggctgaagtgcagtggcatgatctcggctccctgcaacctctgcctcctgggttcaagtgattctcctgcttctgcctccttagtagttgggattacaggtgcccaccaccatgcctggctaacttttttaaaatatttttagtagagatggggttttgccatgttggccaggctgacctcaaactgctgacctaaagtgatctgcctgccttggcctcccaaagtgttgggattacaggcatgagccaccatgcccagcaggtcctaattttcaaatacccaatttataatattctgtctatacaaatggtgggccagggctgcgtctgggttttgtccttagccacatgatgattggccacagctgctgggacaatgagatgaagaaacaatttaccttcttctttgtgccacaaaagaaatcctttctccgttccaccctctaccccaatcttcaaccctgctcccccttggccagggttctctgttttgcagagatgagagctggttttattgagcactgaccctgccctgagcacatgcggcattcttgccatacacagtctcatcagctggagtttacttgcttcctttgactcagggggaaaccaaggctcagagaagtgacagcaccttgttcaaggacacgcagatgatctggtccaaattgtgatgctcctgctgccacaccacaatgatttttgcatctgctgccctgtcatctggtcagaaacaccctaattttctttctttttttaatttaaagcattttttattttttaattttaggtgtgtgtgtgtgtgtgtgtgtgtgtgtgtgtgtgtatactttttttttttttgagacggagtcttgctttgtcacccaggctgatgtgcagtggcatgatcttggctcactgcaccctccgcctcctgggttcaagcgattctcctgccttagcctcctgagtagctgggattacaggcatgtgccacgacccctggctaatttttgtatttttagtagagatggagttttaccatgtaggccaggctggtcttgaactcctgacctcaggtgatccgcctgccttggcctcccaaagtgctgggattacaggcatgagccaccgcgcccggcctgatatatatatttctggatgacgtgagatattttgatacaggcatgcaatgcataataatcacatcaaggtaaatgaggtctccatccccgcaatcatttatcctttctgttacaaatgatccattctactcttgtagttattttattttttagtttattattgagttggagtctcactctgttgcccaggctggagtgcagtggcttgattttggctcactgcaacctccgtctcctggattcaagtgattctcctgccttagcctcctgagtatctgagattacagatgtgtgccagcacgcctggctactttttttgtatttttagtagagacagggtttcaccatgttgcccatgctggtcttgaactcctgacctcagatgatcctcctgccttggcctcccaaagtgctggaattacaggtgtgagccactgtgtccagcctcttttagttattttaaaatgtacaattaaattattattgactatagtcaccctgttgtgctatcaaatagatattattctttctgtttttttgtacccattaaccatccccatttcccccacccactgtccttcctagcctctagtaaccttccatctactctatatgttcatgagttacattgttttaatttttagctttcacaaataagtgagaatatgtaaagtttgtctttctgtgcctggcttatttcacttaacatccatgttgttgaaaatgacagtacctcattcttttttatggctgcatagtacttcattgtgtatatataccacattttctttatcagttcgtctgttgatggacacttaggttgcttccaaatcttgtttattgtgaacagtgctgtaataatcatgggagtgcagagatctcttccatgtactgattttctttcttcctaagttttttgcttgtgttcgggcgtgtgatttgtgcagaactgactctactccgaggctgggtgggtgaatgaggcctggccaacgaatacgttctggtcttttggctaccatggcagggttaggaatgcacatagcaccccatgctgggtacttgagagctggaaccatcgggagattctgctggctttgctacatgctagaatgtaagtgtgaaggtattggtggctcttcttgccactccattggagaatcaagctaacatggcagagccaagaggcagaagtggagatctggtgatggtacctggtcccaggcctggatcagtcatgcctgggagatcccatgggtatgagctaataaatgcatgagctaatgaacccccttgacttacccttttcattaagctagtgtgaactgaggttttatggctttaaaccagagccctagttttaaatcatgattcctctactggattttatactcttctagttttgggtttttgtttgtttgtttgttttttggcagatagcagacaattggatattccaatgacaatatggcccatcttccctaaactcccactgttttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcttgagcccaggagtttgagaccagccttgggaacataatgagactttgtttctatttctatttaaaaaaataaagaacccatcactgtgaactcttgtgagaatccagtgaggagacgtgtgtaagtgcctgccacagtgcctggcacatggttggaaccccagaatgtatatggtcccagtattattgtttctatgctgtgtcccaaaaagctgacttatgtcaactgtgggagcccaccatttcagaaattactgaataacctgtggaatttccccttagttacaaaggttactcttttaaaaactctgtcctcggtcaggcgctgtggctcacgcctgtaatcccagcactttgggaggccgaggcgggtgagtcacttgaggtcaggcatttgagatgagcctggccaacatattgaaaccttgtctctactaaaaatacaaaaattagctgggcatggtggcacatgcctgtaatcccagctacttgggaggctgaggtatgggaatcgattgaacccggaggtggaggttgtagtgagccaagatcgtgccactgcactccagcctgggcaatagagcaagactctgtctcagaatgaacaaacaaaaaataaaaactctgtccttaaggacagggtgatgcttctctaccttctcctttaggggcaggatggagtaaccactggactgaagaaatgatctgtgagtccagacgtggtggctcatgcctctaatcccagcattttaggaggctgaggtcagagaattgctcgagccgaggagttcaagatcagcctgggcaacaaagcatgatgttgtctccacaaaaataaaataatgaagtaaaatatctgaaacctgctgcagcctgttcattggtgttaagataactccctctcccagaagccttggctaagcacactgtcgaggccagtgcttctcaataggtgggtgactttgtcctcctcacccccagggacacttggtaatatctggagacattttgggttactgcaattggatggtatgctactggcacctatgggcagaagccagggatgctgtttcacaccctgcagcaaacaagacagccctgtccacccaacaaagaattgtctggccacaacattactaaagctgaggctgagggaagttggtctaggctacatgtttttctctttacagagaaaatgacccatcatgtctcctaatagagaaacgctgcttccggccgaatgacaagagctcacgcctgtaatcccgacactttgggaggccaaggcaggtggatcacttgaggtcaggagctcgagaccagcctggccaacatggtgaaacctcgtctctactaaaaatacaaaaatttttagtagaaatttagtagaaatttttagtagaaatttagtagaaatttagaataagccaggtgtagtggcacacacctgtaatcccagctacacaggaagcagaggcaggagaagtgcttgaacccgagaggcagaaattgcagtgagctgagatcatgccacttcattccagtctgggcgacagagcaagcctctcaaaaaaaaaaaaaaaaaaaaaaaaaaaaaagctgcttcccagattgggcaacagaaatacgagtggtgtgcagaatgagtgtgtaaatataggtgcataggaacatggggagggtgaatccatgacatgaggggaggtgtgcacggaggggtatgtgtgcacacaggtgtgtctgtgcccaggttgtgtgtgtgtgcgtgcatgcatgtacttgtgcgatgtatgaatcagtgcctataagtgtgtgcatcgtgtgcaagtggcacgtgtgatgtgggcctgtaagacaggaaattgtgttgataagaaatgtatgggatgatgggtactgacaggtgcgggagtggattttgtgtctctagagtgtaagtgactggcttgtgtgtgtcactgtatagagaataagttgtatgtggaaacaggaggagaaaggaagggacccaaggcatgagccaccattttggtttcccagggtggcccacgccccgacttaccgctccggaggcctgctgggcagcgttggtagctggcaagacaaagcagagaagccagtaaccaaacagcactccagatgactggactccctttttcctctcggtgtgaatcaggaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatcgtggtgagccacacagtaggatgaatgaggaattctggggcctcaggcgttccctgttggattttccaaagagcgacagccacgctggaggtacacaggactatgagggcgaatccaagcacctgaggatacaggcttagataagcttggggggcaataagagaggtcacagcaaactggtaggcggccccatgtccaactgggagctggttctgcaacatcctggctgatactgagtataccagggtcaccagctagcaacgtgccaatgtgaacaatgtgtaaagggcattgcagatcactcctgacctgtaactgtcatataaataatgcacaggaagggcttgagccaaccgagtgttttccaaaatgcaggaagtgctccaatcgtgcacatatgagatgactgtgggtatggagaaacagcaggaaatgaaatgtactcaccaggtaaaaaactatcctttctccaagtcatttttcaatccctgctatgaaatcaaggagcaactctctgttgggccagtaagtctctagggtctctctaatatattttggtttctctattgaataaaagaaaggaagaaaatgagagaacgtgggcacaccagagggaaggccagagctaggttacgttggaggaactgctcaaagaacctcagtttaaagcagaagttggcaaactatcaatcatcaaagaaaaacaaaaagcatatgtcatgacaggtgaaaattacatgaaatccaaatttcagtgactacaaataaagttttattgaaacgcagtcggccgggggtggtggcttacacctgtaatcccagcactttggcaggccaaggcaggcagatcacctgaggtcaggagttggagaccagcctggccaacatggcgaaaccctgtttctactaaaaatacaaaaaaatagcgaggtgtgggggtgggcacctgtaatcccagctactcgggaagctgaggcaggagaatcacttgaacccaggaggcggaggttgcagtgagccgagatcgcaccattgcactccagcctgggtaacaagagcaaaactgcatctcaaaaaaaaaaaacaaacaaaaaagtaacacagtcatgactattgtctatggttatgactattgcgttcattctggaatggcagagttcagtgttcggaaggaagattacctggctcacaaagtctcaaatactgtgtaccgcttggctctttaagtttgccaacccctgggttggtggcgggtgataatgtaaaaattaatacaatggcagaagaatgaatgaactctgaagaacattctttggaagcctacaagaatggagtagaagaggatggatgagcagaaaggctcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtctgtcgctaagtctctgggcagactgctcggccgcgatcctgccggagaagaggcggggctgggctggtcgggctgggctggtccggctgggattcgagctccgggatcgggaggccccgggcaaggtccagctgcgcggcgggagtgaggccacgggaggtgaaaacaggcgaggtgggggatgggggaagagaggcgctcggggagctgggacgggcaccgggttggggggtcccggaacccctgaaagttcagtgacacctccatagttccctcttccccctgcaacaagaatcactccagacttcctaaacactttggacccagcaatttccaggagttcatcctgatgagagaactgaaaggtgtgcacacgttagtaacaaggaggcctggtgaccgcctaagcgtccaatcgcggggaccaccgggtcgaggccgagaggatggagaccgcgtcacaggcacctcgctgctggaatggagggtggtggggagaacttagaagattatgcaatgggctggcagggctatacccagccgccctggtaagcagaaactcaagaaacctctagggtcctgttttctggtcgtatgatcccaggagtgcacatgggcccctcgggtgtctgaacagaagggcataggagggagggccgcagccctgcagtcttactctgctggtgtagcggtcacctgccaactcccaccccaccctgcaccgcgggctcctgagtcggcagattaagcattttataaattctattttaaatacgtgttttaaacttgtcagatatttgtcttcatttcagtccctgcgcctctacctcttgctgtggtcgcttatttaacactggggggctacgttctgctaagtcccagggagagactgttcctaatatccgagggagatattattcctaatatcacgctgggtgaacaccacgtgtgtacagcctctgatacgattggtaatatccaagggagatattatcctaacatcccagtgggtgaacaccatgtgtgtaaacgctgtggtattattagaaatatccaagggagatattactcctaatatcacagtgggtgtacatcctgtgatattattcgtaatatctgaaggagattttactcctaatatcacagtgggagtacacactgtgatattatttgtaatatccgagggagattttactcctaatatcacagtaggtgtacaacctgtgatattattcataatatgctagagatatattactccaaatctcatggtgggtgtacactctgtcatagaattcgtgatatcctagggagttattaccgctaatatcacagtgagagtacaccctgtgatattattcatactatcctagaaagatattacttttaatatcacagagggtgtacaccctgtgatattattcataatattctatgaagatataactcctgatataaccgtaggtgtataccctgtgatattatttgttatatcctagggagatactacacctaataccacagtgggtgtacaccctgtgatatgatttgtaatatcctagggagatataactcctaatatcacagagggagtacaccctgtaatattattcataatatcctagaaagataatactttcaatatcacagtgggtgtacactctgtgataatattcgtaatttcctagggagatactactcctaatatcaccttgagtgtacactgcgtgatattattcgtaatatcgtagggagctattgcttttaatttcacagtgggtgtataccctatgatattattcataatatcttaagaaggtagtactcctaaaatcacagtgcctgtacacactgtgatattattcataatattctagggagatgttactcctaatctcatagtgggtgtacaccttgtgatactatttgtaatgttctagaaagatattccttttaatatcacagtgggtgtacaccctgtgatatgattcgaaatattctagggcgatattactcctaatatcccagtgaatttacaccatgcgtgtacacgctgtgacctcccagaaagatatgactcctaatatcacagtgggggtacaccctgtgctattatttgtaataccctatggatatcataatatcacaatgaacgtacaccattgtgtacatgctgtgatattatttgtaatatttttgggtgatattacccctaatgtcacagtgcgtgtacatcttttgatattatttgtaatattctgtggagatattgcccctaatatcacagtgggtgtatactctttgatactattcgtaacatcctggaagatattatccatattgtcacggtgggtgtacaccctgtgatattattcgttatattctggggatatactattacccctaatatactgtgggtgtaccccctgtgatattattcactatatcttggagatataatattacccctaatatcacagtgggtgtatactttgtgatattattcattatatcctgaagagatattatttcctttaatatcacagtgcatgtacaccttgtgatattatttgttatatcctggggagatactactatattactcctagtatcacagtggctgtacgccttgtgatactattcattatatcctggggagatattattactcctaatatcacagtaagtgtataccctgtgatattattcataatatcctgggagatattacccatattgtcacagtgggtgtacatcctgtaatattatttgtaatatcctggggagatattattactcctaatagcacagtgggtgtacaccctgtgatattattggttatatcctggggaggtattattattcctaatatcacagtgggtgaacattctgtaatattattcattatattttggggagatattaattcctctaatatcacagtgggtgtacaccctgtgatattattcattatatcctgggaagatattaatccctctaatatcacagtgggtgtacaccctgtaatattattcattatatcctgggaagatattatttcctctaatatcacagtgggtgtacaccctgtgatattatttgttgtatcctggggagatattattatgtctcatatcacaatgggtgaacaccctgtgatagtattcgttatatttggggaagatgttattacccctaatatcacagtggtgtacactctgtgatattattcattatgtagtggggagatagtattacccataatatcacagtggatgtacaccctgtcatattatttgttatatccttgagaaatattattattcctcttatcacagtgggtgtacaccctgtgatattattcgttacatcctagggagatattgttacccataatatcacagtggatgtacaccctgtcatattattcgttatatccttgagagatgttactacccctaatatcacagtgggtgtataccctgtgatattattcatcaaattttctggagatattattacccataatatcacagtgtgtgtacccactgtgacagtattgattatatcttggggcgatattactcttaatttcacagtggctgtatccctgtgtttacaccctgtgatgttattcataatattttagggagatattactcctaatatcacagtcagtgtataccatgtttgtacaccctatgatattatttgtaatattttagggagatattactcctaatatcgttgtgggtgtacagcatgtttgtaaacactgtgatattattcataatatctgagagagatattactgccaatatcacagtgggtgtacaccctgtacaccgtgtgatacgattcataatatccgagggagatattactcccagtatcacagtgggttaacaccctgtggtattattcataatattcgagggagatattactctcaatatcacagtggatgtacaccctgtgatattatttgcaatatccgagggaaacattactgctaatatcacagtgggagtacaccctgtgatattatttgttttatcctggagacatattattcctattatcacagtggttgtacaccctgtgatattcttcgctatattcatggaagatgttattacccctaatatcacagttggtgtacaccctgtgatattattcgttatatcctggggagatattgttacccctagtatcacagtgggtgtacgccctgtcatattatccattacatcatgggaagatattattacatctaatatcactgtgggtgtacaccctgtgatattatttattatatcctggtgagatgttattactgctaatatcacagggtgtgtcaaattttctggagatattattacccttaatatcacagtgggtgtgcaccctgtgtgtacactctgtaatattattcgtaatattttagggagatattactactaatatcacagtgggtgtacaccctgaggagatattacttcctctgatatcacagtgggtgtacaccctctcatattattcgttatgtgctaagtagatattattacccctaatatcacagtgggtgtacaccctgtgatgttattccttatatcccaagaagatattattataactaatatcacagtgggtgtacaccctatgatattatctgttatatactggggggatattatttgtaatattttagggagatactactcctaatatcatagtgggtgtactcatattttacagatatattacttttaatatcacagtgggtgtacaccctgtgtgtacaccctgtaatattattagtaatattttagggagatattactcctaatatcatagtgggtgtacaccatgtttgtaaaccctaggatattattcataatatccgagggagatattactcccaatatcacggtgggtttacaccctatgatattatttgtaatatctgaggcaggtattactctccatatcacagtgagtgtacaccctcctatattattcataacatccgagggagatattacttccaatatcaaagtgggtgtgataatatctgagggagatattattcctaatatccgtgggagatattattcctaatatctcagtggttgtaccgcgtcacagtgggtgtgcactgtgtgatattattcatagtatccaagggagattttactcctgatatcacagtgagtgtacaccctgtgatattattctaatacccaagggagagctttctcctaatatcacagtgggtgtacactctgtgatatttttcataatatccgagggagataggatggagaccacgtcacagtcccctcactgctggaatggacactgtctacccgtggagtggtggggagaacttagtgagattatgcaagcgtttagcacactgccagatatacattaaatgctcagaagacttagcttttattattactgtcataattgaggccatgggttactaaccagtggtttaaaatgccattgcagctgggcacggtggctcatgcctgtaatcccagcactttgggaggctgatgagggcggatcacttgaggtcaggagtttgtgaccagcctggcaaacatagtgaaaccccgtttctactaaaaatacaaaaattagctgggtgttttggtgcgtgcctgtagtttcagcttctcaggaggttgaggcaggagaatcgcttgaacctgggaggcgaaggttgcggtgagccaagattgtgccactgcactccagcctgggtgacagagcgagactctgtctcagaacaagcaaacaaaatgccattgaagacatatatgaatatgaaaaggtgcttgctaaatgatgattgaataaaagagattataatataaaataggctttggtttttttaaagcaaaaaagaaaaggatatgcctaaattagggaacatggagaagaaggccaaggcatttaccttcctctcttgagtctttttctctctccgtctctgttttttttttttttttttttgagtcagggtcttgctctgtcacccaggctggagtgcagtagtgccatcatggctcactgcagccttgacctcctgagctcaagcaaccttccacctcagcctctccggagtatctgggactacaggcacacaccaccaagcctggctaatttttaaatttttttgtggagacttgtctcactttgttgcccaagctgctttggaactcctggcctcaagccatcctcttgcctaggcctcccaaagtgctgcgattacaggcgtgagccaccatgcccagctctctcttgggtcttaaagcaaagtgtcaaagacccagccaccacttcttagaaatgactcgatgtcatactagcataaatgcatcgataaaaagatggaaatgtggtaacacagtgatcttggggaatcctagttttcttttccaatttctttgttgttgcagtgagcaagtacttgtttcaagataggaatgaaatattcggctcttttagacagacaagcacaggtgctcagtttgggagaagaattaaaatcctctgcactctccatgctgccttgctaattcttggggtcctgtcctcatcttctactcttgccttctgcagggaccccacagtgtgttttccccgatctttttgtatcactctaaatccagtattgggcccagggagcaccccctcccctgcccccttcagctgtcctcctgcctgagtcttctggaagcttcgggacagaaagaacccaaggatttgtcatgaagctcagtgtggcaggtctactgtttccatgtaaatcatgtctgcttatctgagctggttttggtggaaactgatggaaattatggggaagctaaatccctgtctctctgcaagccactccccaatcccacccccatgaattggcattgtcacagtcctggtgcttcatttctttctatatttgaagatgaatttgagggaaatagtcagaaagtcaagaagaacacagcagaaatcaattggggtgagtccagaacaaaacttggggatcccacttcctgctttttttttttttttgagatggagtctcactctgtcgcccaggctggagtgcagcggcaagacctcagctcactgcaacctgtggctccctggttcaagtgattctcctgcctcagcctcctgagtagctgggattagaggcatgcgccaccacacctagctaatttttgtatttttagtagagacagggttttgccatgttggccaatttggtctcgaactcctgacctcaaatgatctgcccacctcggactcccaacatgttcatattacagtagtaagccacggcttctggccccaattcctgctctctagctccgggaaaacctgtggctgcatgcagagtcttagacaacttccttttcctctctgggcctcagtttcccattctgtaagatgagaggtttccataggcctacactttctaattggtggctttcaatcctctggtgatttgcataaaaggcatctatttcaattgtggttataaataacaaaccccaataaatagacgaattatttaaatggtttctcattatcactgaatagttgagagtctactgtatttgagtgaaaatgcagcacgagaaactgaaatcagatgcgctcatgattatgaccctgaggtcaatgtgtcattcccttcattccctccttgcccccatgaaggtttgactactgtatggtttgaacctgtgcttcttagttgtttattgcttaagttttagccacaacggcaaattgcagcgggaaattcagtcttactttgtcatttggaaacaaaatacaaaacctatcaaaataaagcactagcttttttttttttgagacaaaatggaagaaatcctaatattaggttagaaaagcaattttttggtgtttttaaaattttatttatttatttttttgagacagagtcttgctctgtcgcccaggctggagtgcagtggtgcgatctcggctaaccgcaagctccgcctcccaggttcacgccattctcctgcctcagcctcccgagtagctggtactacaggcgcccgccaccacgcccggctaagtgtttatatttttagtagagacggggtttcactgtgttagccaggatggtctcgatctcgtggcctcatgatctgccagccttggcctcccaaagtgctgggattacaggcgtgagccactgtgcccggcctctttggtgtgtattttgatgtggtgactggtagttaaattcagtgtacatatgaattcactcttgggacaaaatatgctggatttgagcttgttttcaggcaaatcatgtttcatcttgcagagctaattcaaagtatactgactgcatgcacttcttgcttaggggaagaaaactcatcaaaatttgtttctaggcatatgttattagagctaggattaaaataaatcttacatactttctttaatatgctaacattaacacgtttcgcttaaaaaagtatcgatcatttatcatggaaaaatacaccagcttacacaaattcctaaagcgtttttcgtgtgtgtgtgtgtgtgtgtgtgtgcgtgtgtgtgtgtagagatggggtttcgccatattgcccaggctggtctcgaactcctgggttcaagcgatccacccacctcagcctcccaaagtgctgggattacaggcgtgagccacacacccggccctaaagctttttgtgagattatatattttacctgcgaaatatatgggtcagaaagatttgagaaagttgttagataattccaccaacgaaatctcccgtcctttccagctgtgatggtgaattctaaagtagaattcatctttggagcttctccctgtaggcatgcaccttgcgttgcacctgccagatgtcgcgcggagtcctccaggcctctagaaggcagagatggtctcgtttccttgccgagcatgcgccttagttctctcttctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagcatcaattcccatcccatagatactgacctagtagatcagtattggcaaccctggggccggaaagctattttttatttctccggctcccctccacttctgaaaatggagagttgccagctgccctgattgccttaatgagtagttaatggaattaccctagagatttgtgctgaaggttttttttttttttttttttaattaagttgtaaagtcctgttaaatgtttatcagcccggtgggattatgacccagaaaggttcccgtaaagaggaaagggatggatggaggtaggggcagaatgtcatttgtcccggtagatgggaggggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcacctttgagctgttccagggctggcagtgaagggtgaagctctgtgttctgcaaagcgggctgctgaggattgggggaggggtagggagtcagttccacaccccaccagctctgcgacctgcccttgctctaggtttcagtttttgtacctataggatggtgttgggagagaaacagtggaacccagcagatacatttctttaacaagcggatccgtgatcttcttcaaggcccccttgtttgctgctttttcagactgaagaggtcagaggtcaggcattgaatgaatctacccactggcagcggcagggctcctaggatttcctgggtacatgtttctgggtgcccatgccacctcctaggtctgcactggggacaggacacgttcagggtggtatggctgtagacggcacagggcatttcagaagctgaaatgcaagaggccgctaaggcctcttgcaacttgtagtttccaggggttctggaaggaaggaaaagacaggcacccccctccaccctcaccctcatactaatagtgaccttgagagcagagaacaggttttgtgacccatttcaaagtgtgttccttaagcccaagggctgcctgtccagatggtgtgggacactcattctttcataagtaattcagattctgaaatcagacatttcatactggccatcttgatgtagattacattgccatcctgtgtcctgattgtactttatgaaagatgtagaaacaatcatgatatttcacggttatttcttgattgtgttttttgtgttcctatgcaactgccgccattcttctctagctttctcccatcctgagtgtttttacatcgtgttcattgagtcaacaactatttactgagccccggcacatactgaagccttgtccccagtgtggatatagcagtacagtgaacagaacagacaaaactccatactctcatgagactgacattttgttctctaacagggaccttactgttaaaaaaaaaaaaaattatactggttgctaatactttaacaatcagcaggtttcacattaaaaactgggtgctttatttctctggaaagccagccgatctttaggctgccacacttggcttgggttttgtagtgatctgaatccttttggatgaatgtcccttgatgttgcctccctaaccggtctagtctggtgaatttccagtccctgccttaaatgcatgcatctgaatctctttgtcacctgtagcaaattcactgagtacctagagtaagctagacactgtctcaggcactggggaatgaagttgtcactgacctcagagaactttacatacaggcttaaccttatttcacacgagtcctttcccaaatgttcaaatgttcgttttatgagttagtcactttgtacatcatcttagctggtgagattcgactgtttcatagcggctcgtgtcatggtttgtttcatggtcatagagcattaacattttggaggtgaggcttttaggtgcatcagacccaactgcttccttttacagacatggaaactgagcctcagagtggttgagctgtgcaggtacatttaggaaattttccttgagcccagtatgttccctacgtattacactgtgttgcctttttcttcagagagagatattaaatagtgatacaaactgctttttccattttacttattttattttgttttattttgaggcagggtctcacactgttgctcaggctggagtatagtggcaccatcatagctcaccaaagcctctgactcctggcctcaagcagtcctcctgcctcggcctcctgagtagctgaggctacaggcacgtgccatcatgcctagctaattttttttctagtagggatgaggtgtggctgtgttgtccaggctggtctcctgggctcaagtgatcctccttctttggcctcccaaagtgctgggattacaggcatgagccaccatgcctggccgcaaactgatttttctttgaatccatattctgtagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatgtaagagttttagagagtccttgaagagaggacagatattaaatgtctttttagtctctttttcttcggagaatgaaagtaatgagaaaattaagtttctagatgaatgttgctccaagtatttgaaattattcagagttagtaaggaagatttctggccctcattgcagacctttagttgagaaatagaggtgggccccaggaatttgcaatttattttactttattttattattatttttgagacggagtcttgctctgtctcccaggctggagtgctgtggcatgatcttggctcactgcaacctccgcctcctgagttcaaacaattttcctgcctcagcctcccaagtacctgggactaccggtgcctgccaccatgcctgggtaactttttttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaagaaagtcaaggtctttagaagtatgtgaaataaatttgtacccttttcgctccaattttacctccctctgtagtgataacctctgataatctgataaaggttttttttgttgtttttttttttcttcttttgagttggagtctcgctctgtcgcccaggctggagtgcagtggtgtgatcttgcctcactccaacctccaccccccaggttcaagccattttccttcctcagcctcctgaatagctgggattacaggcatctgccactacacccagctaatgttttgtatttttaatagtgatggggttttgccatgttggctaggctggtctcgaactcctgacctcaagtgaaccacctgcctcagcctcccaaagtgctgggattacaggtgtgagccgatgtttccggccctcttataaaattttgatgtgcatcctaacagattgctttctatttatagttattcagatatccacgggtacacatgcatatgtatatatggaaatacacacaagcacacatgcacatcgatatgtatccacaaacacctctatacaatcccatcctcccacatataaaccttttatttggaaatacagattcataggaagttgcaaaaatagtcaatacacatagttttgattttgatatattttttaatacaaatgaaatcaaacaataggatttattctgcagtttcattttttcccctgtgttaatgctttcaataccagagggacatttggttttttcctcttgcatgctttcaacattagcatagatagatctactgacttttttttttttttttgagacagagtctcactctgtcagccaggctggagtgcagtggcgcgatctcggctcactgcaacctctgcctcctgggttccagtgattcttctgcctcagcctcccaagtagctgggattacaggcacccaccaccatgcccagctaattttttttgtatttttagtagagatggtgtttcaccatgttggccaggctggttttgaactcctgacctcaggtgatccgcccacctcagcctcccagagtgctgggattacaggcatgagccaccatgctcagcctactgacttctttttaatggctgcatagtgtgtcagagtcaaacccaaactgtaatttatttaactacttggacatatagactttccccaattttaaaataatagtaattttaacataacacaccaggaaatattcttgaacttaactcttcatccagaatgcataggattgatttctagagatggactagctgggtctgtcctgaaatctatttaattaatttttaaatagtatcagtatcagtctcaagaaaccaggaggctggacgtggtagctcatgcctgtaatcctagcactttgggaggttgaggtaggtggatcgcctgagctcaggagtgtgagaccagcctgggcaacatggtgcaaccccgtctctactaaaatacaaaaaaattagccgggtgtcacgtggatgcctgtagtcccagctacttgggaggctgaggcaggagaatcgcttgaacccaggagacggaggttgcagtgagccaagatcgcaccacttcactccagcctgggcaacagagcgaggctccatctcaaaaaaaaaaaactaaaacaaaaacagaaaccagggttgataagtaaaatctagttttatttattgaattaatgagttaacgtattgtttagagacaggatccccttccgctgcccatgctggagtgcaggggcacaattatggttcactgcagcactgacctcctgggctcaagtgatctttctgcctcttcctcctaagtagctaagactgtaggcgcctgccaccacacccagctaattttttaagaacattttttgtacagatggggtcttgctatgttgcttaggctggtcttgaactcctggcctcaagtgaccctcctgccttggcctcccacagtgttgggattataggtgtgaggtactgtgcctggccaaatctagttttagggggtgcctttagttcctgaagatacatgctaacttgtgcaactgtaggcatgtgagggcttaatgggagactcaattaatagaattatagtatgtttagtattaaaagacagtgagtggctgaacctagtgtctttagaactcatgaatgggcttcagcactgtcttctgattgtttagatgaaaacttctggtgttcagcttcagcttgtagcttctgaagagaatcagtgctcagtaccatgtagaagaacaaggcttactcttagaatttcatttccggtgtaaaaaaattttagattaaatgataacactaaactaaatttagccagagtcacaattctcatttcttgaaattacattttctttttttccttttagggggatttcattctgaagattgagcctcccctagggtggagttttggtaagttaactgaatcactagacattctttgtaaaagattagatgatatgccgaatattaatttaggctagcagagtgcataaactattaaaatattaaggatcatttccagtatggaagagggtttgtattcctcccctccttgcccccatcactctggtttagttcggatttaccttaatctacctcaagactttctgtcacctttgaaaaatagacatcttttcttctacctttctggaaactcttcccttgcagtttcactcattacgtggccgtggaacagtatagaaatcaagagtggggacttggttcccatcccaggatggcttcttttttagccccctcagttttttaagtttttatggaattaattgaaacatttaaagattgtgagatttgtcataaaaatccagatttatgtcccatgagatgagaagactgtcagccttataccttaccagttaaataactttgggcaagttacttcccccgtgtcagcctggctcctcactgtcgagcaagggtagttatagtccctgccccactgggtacttggaggattaataaaccaatactgagtgttcagaggggctggcacgtaattagcaagtactcagtattcagaaacagcccttctgcacacatcccaacaaaagctccaaactttcctcatataactgccttcaagcatagctggggagttggggatggggttgagatcagaagagagggtctgttttgatgtagtttacatttttgaagaggagagactcttgatgtttcagtagagcaggtgtgggtgaccccagtccatggcttggggagaggagtagggatcaccgttgttgatatcaggcttgctcgtgcattagacaaggaagaatttagcacctgccatcaccaaggctaaaatgaggctcaggcagctgacagctaatttggctctgtgagagcagctcttttatcagtttatagtcaggggtagggtcgggggtgcctggctggtacgttccagaaagctggagaggaatgcagccctgctcatggccaaagcagaagtccagattggtggcctggaggagtgttgtgtttgccaccccccaccctacccccaactggtgctgttgataagctttttaattgaattatactttcagaaaagtgccttggatgaattttcactaagtgaacacacccatgtatccaccatccagataataagatagcacttcaccagcaccccagaagtccccatcctgggtgctcattagccatcccgccccaccctccaggtgaccaccaccctgaccttctacaaattagagatccatttggtctgttttgaactttatacaaatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcctcagcctcctcagtagatgagattacaggtgtgcaccaccacacccagctaatttttgtatttttagtagagatggggtttcatcatgttgacccaggctggtctcgaactcctgacctcaagtgatctgcccgctttggcctcccaaagtgttgggattataggcaagagccaccacgcctggcctatatttatattttatattcatattttgtatcagtgatctcttctactgttgatggccatttgagttgcttaccgattttggccactaagagcagtgctcctgtgaacattcttgtatgtatattttgatacatgtgtctgcatttttgctgagtatatcacaggagtaaagtcgctgagccatagagctgatacatgctcagctttaggtgtttgcaaacatccaaagtggatgcaccagtttgtgttctcccagcagtgtacaagggtttccattgctccacatcctaacctacacttgatatcgtcagttttttttaattttagcccttctggtgggggtgtggtattatctcactgtggccttgatttacattccactgatggccaatgaggttgcacactttttcgtatgtttatgtttgtttgccatgggctagctatttttgtaagattcctgttcaagtcttttgcccattttttattggagtctttgtgtgtgtgtgtgtgtgtgtgtgtgtgcatgtacgcgtgcaagcacgtgtgtaattcatcttaactgaaaatctcatctcatggttttccatttttttctctactcattactccatattcttcctaacctttcaaaaactcaaccttaacccctattatgatgaactcttcagttaaaaaatggagttaattgctgatattgaaaaatcaagagatggtatataaaatccagatttccagtttttcggagaagttggaagctctggcaaagcatggtagtggttggcagacttgagtggcagttgtctcctttcaatttgccacagtccccctgaggatgctccgctcacttcgaacccatgaggcccctgtggccctggagtttgtgttcctggtttaacatggctgagctcatgtccttggtcagagaacagatccagagccagacttttagggttgaattggggctctgttactcagaagctctgtgatcttgggagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtattttcagtagagatgggcttttgctgtgttggccaggctggtctcaaactcctgacctcaggtgatccgcctgcctccacctcccatagtgctgggattacaggtgtacgctgtgcacccagccgctgttagcgtttatgtcagggatggccttttacagggatgccgaattggaaggacacactctctaagccttgtggcatcttgctgtccctgtgggtgaattgaagtcagcttctcccagagagagcgtgcatctgcttctgacacttacgtaggaggattcctattatttaagttctgagatttttttggaccgccacggtggtgtgaatttagagtcctaacgggtgtgtgcccagctcccgtgattcagattctcaggggagagtcatttctcctccacccgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaacctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttacttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctcccaaagtgctgggattacaggcgtgaaccaccacacccacccagaccaataatggtgaatctataactgatgatgtcttagattcattgaaatagagtcttattttactgttactgttccctctcctacctcatccccaggaaacatatccatgatttatagcatcttttcaatgggattcttgacccaaagagggttcctgggctccacctgggagttgtaagcaggactgccagtgctttgagaggagggtgctttgctgggtgggccctaactttcttctccatggcaggtcctcagcaaagggcagcccctgggtcctgcgggagttcaggtgtctctgagaaacactgggaccgaagcaaagatccagtccacagttacacagcctggcggaaagtgagtagcgtcctgtctcttagtgttgccttagagccgggctctgacaggggtcatggagctgggtttgggagtttggattcagggagttctgggttcagatcctgattcagcctcttaagtttgggtgagttcatgcccgtcagagtgctgagttccccacatgtgaaatggaatccatttgacccatcttgcctagcattgatgagatgattaaatatgagttcatactggccaggcatgttggcttgcgcctataatgccagcactttgggaggccagtatgggaggatcacttgagttcaggagttcgagaccagcctggacaacatagggagactcagtctccacaaataatttaaaaaattatatcaagtagagtcccatgggggaagaaaattagctgggtgtggtggcatgcttctgtggttgcagctactcgggaggctgaggcgggaggattgcttgagcctggaaggttgaggctgcggtgagccgtgatcatgtgccactgtgctccagcctcggcagcagagcaagaccctgtctgaaacaaacaaaaaaagagttaatacccataaagcacctgcttcaaggcctggggcttagtgggtcttcatttagcagctcagcctggctctggagcctgccagcccgggcttgaatcccagctcccccatttgctggctggttgacctagggcaagttccttaacccctctgtgcctcagtttcctcttttgtaaatgaagataattgtggaacctatctcctaaggtactggaaagatgaaattaatattattacttcaagctgcctggcatattagctcaaataggttagctcagttatgattagaaaaaatcattatcattattatatcaaaactgctttgtagttggaacagatgcctagctgaccttgctgagtcagatttaaagcatttatttaatggatgtatatagttgagttgtaaatgttaacagatatgccaagattaataccagaatagttcaaactgataattccgaaagcgttcaaatcattactaactccgttaatatacaaactgagtaaattgcaaaatagaagtttataatgagtctgtcagtaagttattcaattttaaagttattattgttgaaactagttttcatttttgaaataacatttacttctgcttgactggtgcctctccaggcctggtgtgtagcaggaatatggagctgtaattttttttctgggctagtaatttggtgttgaccttactagaaaaaaatagtgtcttgagccttctgaatacctttcatctgcactaactgaaacaatgaaacatgtagcactgggctattatgaaaatgaaatagaacctcaatcttaccaatacttgtagtaatgtgatttccaagacctatccagttattgcaggcaagatttgacacaataaaataccacagaagaagaaatcaaatgcgttttctagttcatttcaccggacttagccttctcatttgtcagttgccttacaaatttgaagggataaacatgttagtatactggcagcagcatttccagctttagctcggctcactctggtgttagtctgtctatggctagtagagtaattttcatcagctgctggtttcttatctcagttgctttgtgcaaaaacccagaatgacttatctgtgtttctctaaagccttttttctgggattcaaagcttatcatagtttaccctgccctgtgtcatttgcatcatcttgggtcagcgtccccctcagcctgtgcatctgttctgttctttttcaccccacttctcccttcccatgtgtttccttggacacttctgtccccttctccttgtcagttcatgcctgtcacctctgtcaaacccagtcgaatgttctgtgactggtccctgctgtgctacaaggattggttttatgccagaaatccttgagattaagggagacgtaagcactcctctttccgatcagcacatggagcacccctcttggcacacagtaagtgctcaataagcgctcttttatgcagatttgtacagtgaaggattgaatttcattcatgctcatttaacaagctaatggaagtttgcgataattccaacattgttttcttgtgctgccaacattagtcatagaattagaaatacttgggttgtttggagaaagttaaatggttattttttatgtcttaggtttgcattttttaaagttctgcctggagattatgaaatcctcgcaactcatccaacctgggcgttgaaagaggtgagtgacagctacgtctatagccatgccaataatatgctggtcttgggacaaatgtagggcttttcaatttaggatatgaaaagaatttatggttcctccaggactagatgaagaaccaatggtgctgttgtttagtttggtagttatttataaggtgtaactcctcactgtagcagatgttgcttgtgttagtttcagttttaggtgacagtgttgtcttcctgctgtgaaatagatctgttttattaactatagctattttaaactaaatcaacaacagaaggccctgacgagatttatttgttgttcttttttcagcctgaaacagaaatctgtaaatatactaaacattctagaaactgtggtacgcgtgaccaaggagaatgtatgagaatgtttattgcagctttgtttgtaatagcaaaatattgtaaacaacctaaatgccttttaagagaagaatggattggggttccatcatacaataggctgctgtatgtcagcagtaatgaatgaaccagagctacatatatcaatgtaactacatttaaaaacagagttgaaggaaatatgattttaaatacttgtgataatcatttatggatacagtcttttttttttttttttttttttaaagacggagtctcgctctgttgccaagactggagtgcagtggcatgattttggcttattgcaacctcggccttctgtgtccaagcgagtctccggcttcagtctcctgagcagctgaattacagggatgtgccaccacgcccagctaatttttgtatttttagtatatatgggattttgccatgttggccaggctggtctcgaactcctagcctcaaatgatccaccagcctcgggctctcaaagtggtgggattacaggtataaaccagtgcactcggccagatacagtctttttttttttttttttttttgcaacagggtcttgctctgttgcccaggctagagtacagtgacatattcatggctcattgcagcctctggttcctggccttaagcgatccttcaccttggcctcccaaggatctggaactgcaggcatgtgccactgcccctagctaaggatacagtcttttttttttgagatgaagtcttgctcttgttgcccaggctggagtgcaatggggcgatctcggctcattgcaacctccgcctcttgggttcaagcgattctcctgcctcagcctcctgagtagctggggttacaggtgcctgccaccatgcccagttaatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatttttttaaatttctttagctggttagaaggtatgtaagtgttctttagcatatctttttttgtttgactgaaatagtttatagtcaaagatcaaaaaaggaactccacctagtaggtgaggttctgtaatagccgtgaaagaccaaattgaaataagacttaagggacatcttgacatgttagcttctgtgttagtattgaagctgtatctcatttttgctaaagaagcattggaatcagtatttcagcttctactctatctgttttattattatttttactctgtaggttttacgcacttataattgatgatagtttcacacctagatgtctcttcttactgtttgtgacttttggttttgggggtttttctcttctgcagcaacatttaaaaatattttattcgaggctgggcgcagttgctcatgctgtaattccagcattttgggaggctgaggtgggtggatcacttgaggtcaggagttcgagaccaacctggccaacatggtgaaaccgcatctctactaaaaatagaaaaaaattagccaggaatggtggcatacacctgtaatcccagctactcgggaggctgaggcaggagaatcgcttgaacctgggaggtggaggtagcagtgagccaagattgcaccactgcacttcagcttgggtgacagagtgagactccatctcaaaaaaaaaaaaaaaaaaatttattcgaaatgaaagagcttacacatttataaatagaagagattttaaggtttacattgtatgttaattgtctgcatagaagaatctgagtttattaatatgagattgggattttcaagtaaagcatgttgttagaagtcaggataatgtttatcttcctggggtgttagtgaccggaagcaagtgtgagggcacttctggcttgctggtgctattctgttgggtaatcagtgcccaatttgtgacaagccctgtgctgcgtgcttagaatctgtacacttttctctgtgtttattgtaccttaacaaaaatgtttaaaaatatacacatattgtgaaaagaacaacttaaggcaaattaaacagagtttaattgagcatagaacaatttgtcaattgggcagctccctgagccagaataggtttacagcgactgtggcactgttgcgtgattggaaagggtttatggacagaaaaagaaagtgacggacagaaagtggaagtgaggtacagaaacagttggattggttacagctggacgtttgtcttatttgcacatggtttgaacagttggctgcctgtgagtagttgaagggtggctgcttgaattgggtgagacttggcaacacgtaagagaaacctttaggccaaacttaaaatatgtaaggaggcagctttaggctaatcttcagttaacactatatatcattaaaaatagaaaaaaaggcaaaatatgctcattaaaaaaattggaacatatagaggaatataaagcagtggaaacaaattttggaagctggaaaagtatacaagtaaaatagcaccatatagacaaaatcattattgtttacattttgccacatttcctttcacttcattttgggcattaaaaaataatgataagccaggcacggtggctcacacctgtaatcccagcactttgggaggctgaggcgggcggatcacctgaggtcaggagttcgagaccagcctggccaacacggtgaaaccctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagattacgtttcccagttaatattttagcttcagcgtgtcctcatgttgttaggcactttgcaagtgtttatttttttacaggttaaaatctttttctgttacaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggtaagcaaagaaaagaacaaaagagatggtgtgaagggtaggagggtgggggattatagaccagaacgtactgttttaaaaaatgcaggtctgagttgatttatcattttaacacttaagaatatcgtctgtctcaggccgggtgtggtagctcatgcctgtaatcccagcactttgggaggccaaggtgggtggatcacttgaggtcaggagttttagaccagcctggccaacattatgaaaccccatctctactaaaaatacaaaaacattagccgggcatgttggcacgtgcctgtagtcccagctgcgtgggaggctgaggcagtagaatcgcttgaacccaggaggtggaggttgcagtgagccaagatcacgccactgcactccagcctgggtgacagagtgagactctcaaaaaaaaaaaaaaaattcaagaatatcatgtgtctctgttgactcacaagacattgcacatctacactgggaggcagtggtatgtgatggaaagtacacaggctttgaaatcagacctgggtttaaacaaatctcagatttaaacaaattcctcttcctagctatgcgaccctgggccggtcacattaccttcctgagcttccgtttccttatttggagaatggtgacccatgataaggaaggacagtcatgtcatctttcccgggaagactgtgccagtttttaactttgcaacttgaatgtcaagatttttgttccttttatctgtattaatgtttcttagatttcagaaatacatatattgacatgaaacttaaaaaaattttcctataatgtggctaattgatggtattcagaacatgtaaatggaaaaggaagtcttgtcttttttaccccctggcataggatgtcctgggctgcaatgtctcaccagtgcctgggttccagccccaagacgagagtctggtgtatttgtgctacacggtctccagagaagatggctcgttctctttctattccttgccaagtgggggctacactgtggtgagtgaagcagatttccgttctgtttatgtctgggactctcatgacacagtaaaagccaatgctgtttgggtgttaaaggaaaagatggttggcctgcagttctctgaacatgctgttaagcagtaacttacttaagatgagacactcaccccttcgtaatagctacaaaaagggcaaggcttcctcttttcaaatctgcaacagttatgatgaatgtttctcttggtctgtctgaaccccttgtcatttgtgggctgctagatcgattattaatattgctgattgatcatgttagtggttcttagtgattaagagactcttccttccagattccgttctatcgaggggagaggattacctttgatgtggcgccttccagacttgacttcacagtggagcatgacagcttgaaaatcgaggtaaggcttttctgtcttctggagggacaggtgtttgagttcccatccctaggcacaggtattgcaaacatgttttaaaaaaaaatcaattattttatctggaagggctgttggaaaaaatgccatctggtattatattcttacccatgatgtccttatcgtagagagctggattcctagttaaatctactcattcaatgaaatatatttattgattgccagtgacatgcatttcaggcaccattccaggactggggatatagcagtgaccaaaagaggcaaaaattcttgtccctgtggacctcatttttttttttttttttttttttaagacagggtctcactgtgtggctcaagctggagtgcagtggtacgatctcatctcactgcagccattgcctccagggttcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtagtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggctactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaataaggactacctgtcatgtgagaccatcactaagaaaccatttgctgaaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaagtccctgtctccatgaggtaacatgctagtgggagggagacaactaagaaatcgaacgaggacatttcagatactggtaagtttgatgaagatattaaaataggttagcagtggtgaccttggggatacacagatcagggctggaactcagtaactgcagagaaagcacagctgtgctgctcacaggcgagtggggcacagacacagacacagacacatggagcacgggaccacgtgtgagccagtgatggtggtggaggagggtggtctaggtggatttctttttttttctttgagacagagtcttgctgcttcacacaggctggcactatcttggctcactgcaacctctgcatcccgagttgaagtgattctcctgcctcagcctcccgagtagctgggattacaggcgcccgccaccacacctggctaatttttgtatttttagtggagacagggcttcaccatgttggccaggctggtcttggactgctgacctcaagtgatctgcctgcctcggcctcccaaagtgctgggattacaggcgtgaaccactgcgcctggcctaggtggatttcataaggacctgtgttcaggtcgtggtggaaagacaggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagtcttgccctgttgcccaggctgtagtgcagtggtgccatctcgactcactgcaacctctgcctcccaggttcaagtgattctcctgcctcagcttcccaagtagctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatgtctgactttcacgatctttcacaggacccctctttgcttaatctttgaggatttttggaagatggtattgttggttgagaaagcttattggaagatgcttcaggtcattggtgtagttcttcctgcttgtagttactcattatactataagtacaggcagggacatcttgtggttgaattcatgtggttttaccatcatctgaagcaagattgtgtagtgccaagaacttgggctttggagtcagatcccagatccacctgtatgtaacctgcagaacagctttagacataacaggtgctcacaaaacagtagcttagaaggagactgcagggtctgcttgggagaagcgcggcatgagcaaagtcaggcagtctcacagcagcatgaggtggctgcgggtgtaaagctgggtgctactggagcagaatatactggcaggtgaaggtgatgatgaggccaaccccatagcacctcctcacaccccaccagggcgtaggggctttctcccactggggccaacgggccatgagtggttttgagcattaatataacaagctttgatcattgttttcaatagggcattctgaaaacaatggcatggagtagagtggctttgaaggggacaggacttgggcacaggaggtctgaaagcagagacgacaagggcttgccttgtagggaagtcagggacagactggtgagatatttagggtgcccagcttgagaggtgtgatggctggggacagaaagagaagccagttaggtgatgaggtttcagatttggccacattggtctgtaggaccactaggtggagctcttcaataggtacttggatggatggtaaatcctgaagatttggccgcaggtggcagccaggacctcaaatatgtatgtgcaagtagaattagaagaacagtaggccaaaaacagagtgccaggtggcccagggggggacctagggagcctgaggtcataggagctaagaaagtaagtttggggtaggaggtagggcccaacagggaggtgcagggagctgggccctggtgaacacagtcccctggcttgatcactgaggaggccacagtgactcttttctgtagacagatggaggtcaaggtcaaggagtccagtggtgaatggaagacagggaagcaaattaccctcagaaagtaattcttggatttaagtctttcccaccttccataaacactttgtgcaattactctagatgaggcactgaaaaatgcttcatacctaataattaatcaaactagtgttccagagatggggctttcaccctaccagggagacagactgaagacaaatacatctgtggccaggcttaatgcctcacacctgtaatccatcccagcactttgggaggcagaggtgggcggatcgcttgagcccaggagtttgagaccagcctgggcaacttggcaaaacaccatctctaccaaaaatgcaaaaattagctagtttcataacctggtctaaaaataaataaagagataaaaattaaaaaataacaagatttttaaaaaagacaaaaaagacaaatacatttatgctgctaaattatggcaaatgttgtgcagggaagagatcagggtgctgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagcactttgggaggctgaggtgggcggatcatgaggtcaggagttcaagcgcagcctggccagcatggtgaaacccggtctgtactaaagatacaaaaggttggcggggcatggtgatgcgcgcctataatcccagcaactcaggaggctgaggcaggagaatcgcttgaacccgagaggcaggggttgcagtgagctgagattgcaccattgcactccagcctgggcgacagggtgagattccgtctcaaaaaaaaaaaaaagagttatcagttggcaagggagtgatagggatcatggtactttaaaaagtttgtttttcttcctggctgctgtgtggagaatggattggaggaaagccatggtgtgaatggaggggccagatatgaggcagtcatggttgtctggaggagatatggtagtggctgggcccaggcggctggcaggcgagggagcgaggagtagatggatttggtaggtcacatggagaacacacccacaggcctgtgctgttgaggttacaggtttcttatttgagccactgggtagatggaggcggtgctgttcacggagatggaggaaatatatttattttctcctttaaagtagagtatttgggtcaaagaaagaaaaatagcatttgttgaacatttttggaaaaatctcttttttttaattggccgatgtagtacatttgcctttttagcacactgatacttcttactatttcttttcctttttattttttgttgagccagggtcttactccgttgcccaggctggagtacggtggcgccatctcggctcactgcagcctccgcctctcgggttcaagtgattctcctgccccagcctcctgagtagctgggattacaggctaatttttatattttttagtagagatgtggttttgccgtgttggctaggctggtctcgaactcctgacctcaagtgacccacccgcctcggcttcccaaagtgctgggattacaggctgagccatggtgcctagtcttcctttaaagtaaaataaaaaaattactcaatttattgtaaaaacaaactctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatgaatgggcagagcgcaacacaactacatttttggacaccacagtttgcatttcatgtaatttttacatgtgaaatattatctttcttttgatttttttttttaactttaaccacttaagagtgtaaaattctttttctcggcttgcagttcatacacaaacgggaggggggtccttgggtggtagtttgctgacccatgctggagatagtgagctcatatggctgggcagtcccttcactctgaagaaatggctgtgtttttcataattcctagatttcacatacacaatcttccaccatttccttgtgttttccactgtttttttatttgaggcggagtggtggttccaacatttaatgtacccctaattgtcagaatccaacattcttgattatctttatgtcagaagtaactaatttttatctaaaatgattcttgaagattctttaaaatgaacagttgaaaagacaactgtgacccccagctaggatgtactattacactttaatacaccagctgcttcagaaatgaagaccagcactccaaggatgatggtcgttgtaggggggcctctcgtgtgttattcgagggatgccttgcaacaccttactccttatttagaatctcaaatctgaatcattaccttaatagggcttttcagttataagttacattgtggctcctacctcccaaggagttcaattttagctttgcattttttaacttaattaccttttctgttccaatctcccagtttgctttcatccatgtattatatataatcacaagcaaggaagacgtctttgataatcctgacttatttgatggcctggtaatgccacagtttcttaggcagcttagagctcttgcttttaagggctagcccacattctcagtccaaggccgctctgctgtcaacgatccaattacctgaaacgtttttattatctgcagattttcttaaaattgcctctgcagtgggggattgccagatgtcacccggaacacacaaacagccccactacgggcccctgttctgtagaaagatgcccagtcttgcttctgaaggttgctttttaaaaccagaatgaaggttgctttttaaaaccagaatcatctggattgcattctgtctcttcattaagattagactattctcaggaacaagggctgggagagggctgcatcttttttggtcgataagagcctttcctgttataattgagtcctcgtgctggaatgaatggtcttctctttgcaggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatgtttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaagcaggccgagaacggggagacggtctggcctgtggtctcatcaccatggtgaaggcccaagccacagctggcccaagcaagcaagagacaggacagagcagaggtcagcccaccatgcctttcagtgcagtggccctgcccttggggagagactgtttccgtgggctgtcacccatcaaatcagcagctgcccttcctccctgtggaagagcaaataacacaaagggagagggccgagaaggttccctgttagactctgctgtcctctagggcaaagtggggtccctccctctgtgggaaacagggtaggagattgcgttctccctgcttccacagaacagcgtggtgtgtgggttgacagctgactttattagatggtagctggcttcttgcgaagatgtccacattgacaagtctttggaagccctttcggaagcatgatggacttctccaaggaagggcagtgtcgtctttactagggatgaaagagttgaccgctgctaccttcacctgttcctcttcttagcccatgaaaggcacgcacaacaataggaggaagaaaatgacttaattccaccaaagtgtcatccacatagtgttgacaggttcagagcttatgctacaagtgatccgaagccgggaaaagtgactgggatgtagtatggtttctagtatgtaagtgaggcgtgtccgcgttgcgggcctgtggggaattaggccagatagacttttgttcatacacatcggtctgttgaggctaatttttcatctgggtagaaccgtgcttacttcacacaagttattcgtggatttgttgtgattgtaaaatcagcctggaaacgaacctttggccttcaaaatctctttagccttggtcccagatgaatgttctagcgccctgtaggtcagggggaagatctccccgaatgcagcctctaacgttccatccacgtttccgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatgttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccgccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcccttttccttgcccttcttaagaagccacttcttgcctgtatttctgctttttcagaaatcagcttggggctgctggcagtggatagctcataaaacagactgctttttctggaattatattaatattttctgttatggcagggcttggcagactacaaaaactgccttttataagcgtagtttccttagaatacagccttgcccatttgtttatggattctctatggctgctcgtgtgtaacagtggccaagtcgagtggttgaggctgacaaagcatgtggcctgcaaaactgaaaagagttacagaaaaagtttgtggatccctgaataccttacttgcagcctgatcttacaggccccattagatttctttcttgatgtaatggaaattggttccagtttttctttctttttttttgaaatttagcctcgctctgtcacccaggccggagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccactgccgtcggcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcagggcttaagtgaaccctcttaggtatcaaagtgtccttggtgtacaccgctctgtactgccaagtgagtttctctgatatatatatatatatatatatatatatatatattttttttttttttttttttttttttttgagatggagtcttgctctgttgcccaggctggagtgcagtggtgcaatctcggctcactgaaacctccgcctcccgagttcaagcgattctcctgcttcagccccccgagtagctgggactagaggtgcgtgccgccatgcccagctaatttttttcttttttttttgtatttttgttagagacagagttccaccatgttggccagactggtcttaaaactcctgacctcaggggatccacccgcgttggcctcgcagagtgctaggattacaggcgtgagccattgtgccccaccttctctggtgtatttgttccagtgcaggggaagaagctgtaaacaggatcttagcttcttgttgactgtggtctctgtggcctgaaaggcagtgtgaaatgggtttcaggagcacctctgtagatcccttcgtgaattttctataatgttttgatgtcgagcggcggcagatgtcatcgtcaggtcttagtttctctgtagagaaactagaagaattggaactggtgtttcatgtgccaacttactcccctaactgcttaattacaaaaactccacaggtcgatttgttataggagatcgattaatatccggttcataataagtgatagatatttaggaaacctttcccttccagcagtggagtggatttccagctctcttgtaataagatccttttttttttttttttttgacacttccttaaccccttctttatctcctcccactgtcccctcactcgccgggccccagccacagtggtcctctgcagtcccacaccaagctcactccctcctcggggcctttgcacatactctcccctctgcctggagtgctgtgacttctccagaaacacgtgttgttggtttttcctcctcattcaggtgcagccctattgttcaggagagatgtgccctgggaccagcgagctaaagacccctcggtggggattgttcttctcttgctttcctgtttattttcacagcttcgttactgaccagttgagatcactaatttatttgttgttgcgttgattttgtcttcctgtattagaacataagccctgtgagagcaggagccatggtcatgactcccaaggcccagccttgtgtctgtcacatagcaggtgctcaataaatattagttgattgaatgaaaaatagcacacttttgttggaagttttgggaggtttttaattttcctgtggcacccaactgctccaatgattaatgggcaaaacagatgactggtttggaaagagaaatattattaatcatcttggtgtctccatctctcttagtaagtcattgtattggctttgctcccttaggaattttatcaggatggaaatgggcgtgagaatgtggggatttataacctctccaaaggagtcaaccgattctgcctgtccaagcctggtaagtttggaaggattgatgtgccatgaattagaaaaatggaaaggcaccagaggatggttttgaaggcatttttttctaccttggttctgtttgcatcaagctttcaatttctgtgtgttcaacctgctcttgtttttctgtctgtcttgggtttgagttgggtagacaccactgggccctttcacctccaaaaatataccattggccaatggcctctctttatagagctgttttaaaatttgaatcatttcccactttgcttaaaatctttcagtggcttctcgctctttctcattttttttttctctttctttttttgagatggagtcttgctctgtcacccaggctggagtgtagtggctcgatcttggctcactgcagcctccgcctcctgggttcaggcgattcccctgcctcagcctctcgagtagctgggattacaggtgcccaccaccacatccggctaatttttgtatttttagtagggatgggtttcaccacattgtccaggctggtctcaaactcctgacctaaagtgatccgcccgcctcagcctcccaaagtgctgggattacaggtgtgagctgctgcacccaaccctctctctcttttataatggctttttttggaggcagaatttgcatatcataaaactcacctatttaagatgtacaataaaatgatttgtagtaaatttatcaagttgcacaaccatggccagaatccagttttagatttgttcatcacccacaatgtaagatcctctgtgcccgttgacagttaatccctgtttctagccatggccagccactgatctattttctgtccccatggattggctttttttggacgtttatcatacgatgctggtattttgtttggcttcttttatttaacatgtttttgaagtttatctgtgtcatggcacatatcagtagtttgttctgttacattgctgtgtagtattctggtgtgtggttatatcatattttgtgtatccatttatcagttggtggatatttgagtggtttccagtttgacgctgttatgactaatgttacggacattcttatacaagtctttgtgtccgtatgttttcgtttttcttgtttcgatacctaggaatggaattgctgcattgtgtgataagtttatgtttaaccttttaagaaactgtcaaattgttttccacagaggctgtgtcatttgatattcccaccagcaatgcacgagggttccggtttcttcacctccttcgccaacatttgttattgtctgttttattatagtcatcttggtagatgtgaagtcgtgtctcattgtggttttgttttgcattttcctaatgaataattcagtggctcctccgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgtggttagaaaacttatgtttaaaggaggaagtcaaggagagggcaggcaaacatttccttgcgccccctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggatgcctgttgaggaaacaatgagccagcctgtgaggcagatgctgttctctgtggacatctcctcctgcccctcctagctggggccttcttacccatcagttcagtattgcttcctggggaaggatggcctccagggccacttaggcctgcctcctacactcttgctctcagcactcacttctatccccttcttgcatgtgccacaattgatatgtttgtggctgtcaaatgctccccctctctgtggatggtaaactccatgaagacagggaccactgctctgtcattccccactgtgtaccagtacctagcataatacctggccaggaagagatgctctgtcgatatttgttgaatgaaagaccaaacaaaacaaacagagaaacctgatttttttttttttttttttttgatggtaactactctggggcttgttgagtgcaatgaaaacagcagggtggttttagctaatttcaggtttttgtaggaagtgtggccaaaatactggttaatgatgatttgggggaaatacattgttattccttgtatcttcctgaaattgactgtgttcctctggcaagtgatgaaatgtacccctactcggagtgtcctcccacacagactcacacttttctggggcttcccttactccttacctcctttttaggaatatttataggaagaaattgaggctgtggttatctcttggatccttaatagaatcttttaagtaggaaattatcctcagtccaatttgcagtagaaacgtactttctgttccttctcgtgcatgggtccgttcacctggtctgtgcagatttaactactgtgagttgttaccttatggaaaatgaaaatcatgcgcctgtgatcgggccattgcatggatcgggtcattggtaagacgccttcataggcagtgaaaacgatgcctgcccagtatttctgatcccattattgcagatctgcgatacatttgagttttcacatgcaaagagctgccactcgatttcagatgtcggaattgctcagtgtaatagatgccattctctgaaaattacttttgatttcctgtctgtaggtgtgtacaaagtgacccctcgctcctgccaccggtttgagcaagcgttctacacctatgacacgtaagcctgggaattgaatgctttgtggtgtttgtatacattccgtggaggattcttcatttacttcagagaacaaaaggagtttttctgttttttttctgaaagaggcaaggttaggccttcaacagcatttctagataaggattttaagacacttggattagttactgaggaaccggagacaggatccctttcccaagaattctgtaaccccaggatagagggctgtgtttttgaagtgccttaaatagaagctttgtcaaatctcccagccctcaccgatgggcatctgtcaagttcaagtctgccatttttgtatttttacagacgtgtgtgggtttcactgggaattggaagcataaagttgtggagtggagaattagtttactctttaaaatacttctctggatctccagagttattttaccccagactaaaagcaattttctgtagtatatttagggtgaagaaggatgcccaaaaagggtattgctgatgatcttctgagaatgagtaggttctagcgtttcctctgctttgatttgtaggtcttcacctagtatcttgacattgacagccattcgccaccatgtccttggaactatcaccaccgacaaaatgatggatgtcactgtgactatcaagtaagatgagcgttctgcagtgggccgagagtggcgggagagggtgtggatgaggcctggggagtctctaataggctctctggaaattagttttgatttcttatctctagatgtatatacaaatggccttccctctcttataggacattgccgtcaattcccagcagccttgatcctttccatttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcattgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatgttacctcctttcagcttgattacattcatttttgtaacttcacaagggtgtttgtgttgcttgcttgtgccggaggttgtatggaatgcatcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccatcatctagtccctttttaccacttggccctcagccttggtctgacccccctctggggtcactgtagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctggccttcccttctcaccacgtggccctcagccctggtctgacccccctctgggatcactgcagcagcttctcagctggccttcctgtttccgccattgctttgtgtattttccatgaaggagcaaacgatttcttttatcataccattcctcgactgaaaactccagtggctccaggtcggcaccaagcctgtgaagcctcagtctgacatctgctgccccttggacctctctgttggatatgactcttccgtgggcccctgtgccccaggctggactggtgttgccattgcttgaacatctgagtgagctttctctccaaggactttgcacttggcatcgctttgcccaagctactgtttacccagagagctgcgtggcgcattctctcccttccttcagacctttgctcaatgtcaccttatcagaaaggccttgactgtccctttaatgtaaaacagtgctccgggctctccgtcttcccacactgctttatttttctttattgcacttttcctctggtattatttttctctttattttcagccccttcccactgaaacgtggattccacaggggtaggaagtgtggtctgttttgttgatgctgtatccttggtgcctagttctctatcagagcagttctcagcgaaggtagaatggagaacagaggatggtggtgtggagaaaactccgtgtcctacatggaagctacaagcttatatccagtcgccataaaatcaaccgtatttcattccagcccagatctaccagatactgccaccatcactgcgaagctcagttgttattttttgtgaaactactagtttatttaaaacagaagactccgccactgtggtgtcatgataagatgtccagtttgtaactcgcaagtccatactcgtagaaaggtcaaattcccactgaccacaaggatacgcaaccacgtcctaggggccgccatttctttcttctaggtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtaagctctcttgtgcgtttccctacagtgtcctctgttttgtggggataggacccgccaaactgaagtatattaattattttaggtctggagagaaaatcactgttacaccgtcatctaaagagctgctcttttatcccccttcaatggaagccgttgtcagtggaggtaaatgtcaactcagcgagcgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggatggttgggttggatggatggatggatggatggatggatggatggatggatgaatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgtttggcagagcatgatgggagggtctttttttggggaatggatgactgaagtgatcacttgtggagtatttgtcttttgccacttattatttttttcccagcactctggcttcgttaagttgtgggtgttatgtggttcgcgtttggaagcagagggtgttgaagagcgtgacttctagcaggcaggctgtttggggcggtctttctcagtgggtcctccagaggctgagcagcacggcctcctgtctgctgtaaagtgttccctcctgatctgtggcctcctgagaacctaggaagagtagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatttgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcagtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacaggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccactagaaaaaaaatgaacaaagattatgaaaaggaaattcatggaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgagacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacagaatcatgtttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagtgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattacatcattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatgtgtattttttgtagacttatacagaatcactttagaggaagagtaattggaaagattgggtttagaaaaatggaccattttctactgaatatatggaatgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagcacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggcaagaggggctgcctcttagtggctttatttaggtggcttcattatgcatgaagattgtgagggaggatagaacttttgacctaggaagtggattttcttttttttttcttttttttttttttgagatggagtctcaccctgtcacgcaggatggagtgcagtgccgtgatctcggctcactgcaacctcctccttgtgggttcaagtgattttcccacctcagcctgtagctgggactacaggcatacaccatcacacccgactaatttttgtatttttagtagagacggggtttcaccatgttggccagattggtcttgaactcctgacctcaggtgatctgctcgcttcggcctcccaaagtgctgggattacaggcatgagccaccgcaccgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcggtttgtgaccttggacgtagggtactcaatgacaaacttagcttccttaatgtaagaagcaaagtttgccatgaagcagctctcaggccatcggacagctggcatagaagttcctccaccagctttctcattactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtacaggaagcatagtggcgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaagactcataacgaagacagcaccaagccacgagggatccaccccaaagatccgatcatctcacagcaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggccagtcacttcatttccacatgcctcgacttcgtcctctgcaaaacctagattttggactcagagacctcttataatcttgttcagctctaacaaaatctccatgttaccattaatgaagaaatgtttataaaataccctgcagaccctctgcggatgttagtgatttgctctgggggtacattgttaagatgcgcttgtaattttataagcagttaagtatttggcatgggtgagaaagtgtgtgtgcgctttagtccactctgtccagggcttgcaggcgtgtgcttgtagggaccaggcaggtaatgtcagagagtgcagagggttgggtagggtggggggcaaactggggaactcctgccccatccatgaggggcacaagggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattcccctggtgtgttatgtagaaaggtgccagtgtgggcccagggaggtggtcctggcattctcttgcggcaggtgcactgtggcatcctcacagcctttgccatcagccagggctgcaccttaaccctgctcatgccccatcccgtgtgggagtgagaacaggcaacaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacctacccagagagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagatggcgaggtaatgcctgtggccggattctaccttctgcctttgttttaataattctgctgtttagtttaaggaagcacagttctctccttttctccctaaataccactctgcagaaatgcgctctctgaatcaaaagaggttgggttctgtagggattattttttcttcattgtttttctgtttacaaaaagaatacatattcatggcaggagattttgggaaaaagaagacataagcccatcatccagaaatagccactgctaacatggtgattggtatcctttgggtcttttttcaggcacgtgtgcgcatgcatgtataaatataaatagacatttattttaataattcaaaactgacactgttttgtacattgttttgtaatccatgctcttcaatgaagaatttatcacaaatctgttcctcatcatcaaatctttcttttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgcgccaccacacccggctaatttttttttttgtgtatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgcgatgatttatttaaccaaggcctactgttgggcatgatcgactcttgcactttgaacatatcaccccatgctttcctgctaagaagtccacttttaaaaatgccttgtaatttttaaaaattcctctattttaacattctgctattgagtttagggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcaggaggctgaggtgggaggatcacttgagcctgggaggttgaggcctcgatgagccatgatcatgcccctgcactccagcttgggtaacagagtgagaccctttctccagaagaaacaaaacaaaacaaaacaaaacaaaacaaaacaatccatggggtggcaaaagaaggcatgtccatacaacctgtgctccaggtcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacccctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaagatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcactgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaagctgtgcctgctggggcttggattcccgagcagggccaagtgttgaatgaagagagcgcccactctgtgccaccccgtacagggccctcacaggttgatcctcacaacaagccttcaagcaggtgtgccattcctcccattttcacagaagcccagaaagattgagtcacttactgagtgttagcagaaccaggactcaagtgaggcagtttgtctcaagccacatggtttccacctcgttctgccctccgcgtgatgagtggctcagcattgcatgttcacgggggctttgtaagcacattggtttccttctttgttgatgtgactgcccacagcctcgcgactggattttactcagtattccatgccctgctgagcatttcacatactcctttcatcaagtttcacagcatccacccccagtgggtgttgttcatatgatctccatgtcatagttgagtaaactgagtctcaacgtggttgcctgagtttacccagtgaggcctgggacctgagcctagactgaatcactcttaattcctgctgaattaaacttttatttatttattcattattatttttttctgagacagagtcttgctttgttgcccctgctggagtgcagtggcacgatcttggcccactgcaacctctgcgtcccgggttcaagtgattctcacctcctgagtagctggaattacaggcatgcaccaccacttctggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccagagatacaggagtaggcagttgttgatggaaatctgttcctgcccttattctttcatttatgaaagggcatcccaggtacagcggcccccacagtcactctctagcccagcagttctcggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccatttatttgcttcctttatgagagtagagtgggccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgtctcattgtgctgttccagtgcattgcttttctccaaaatggggcaattggccaaatgctgtctacccagcaaaagggagggcacaccacttccctagggtccagccagggtgtggcacttaccgcttctgttcctgtaccattggccaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatacatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttcccggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatcatagatgtatttcttggatgacatgcacgtaacccccgggagtcttcagttgagccaaatgtagagcaagtcagagtcctgagtgaagctggctggggcaggaaaaacacgagctcagccaacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaagatttacgtgaaattttcccaattttaaatgttagccacaaatgcagtgtttttttaagaaaaccacacactttggccaaacaaaatgcctacgtcggccgggtgaggcttaaaggttgccggcttgcatcagagatccagaggaagtcacagcattttaacagctaaacttaatcctcacaggaagtcatcaagtgaattaagtgatattgaaggaggggacacatccatccatccgacatttattgagtgccacataggacaggcatgggtatgtgaggatgagtagggtagacaacactctacagcgagctggaagaggccagggaggccccgtctgccttgttcttcgtaccccaatgcttggcacttggtgggcattcagtaaggaatgaatgaacgcacgcacagaggaatgaatagatgggcacacagtgtgtgccctcacagcacatggcccatcactgggtagaaggcaagtcagtaagtagacaggggtaatgcagggagccgagggcctccaggtggaggaacatggaggaccacaggagcacagagcagagttctcatcccactggagagcttagggaactttctggatgtgatgcgtgagcagagtccaaaaggacaaaacagagagagggaaaacaaggtggaagttcttgttaggtgccactgccaccccagggggtcagcttgggggactccctggctcttgggggccaaccgcagagctgccctgttcccacctatcagctagcttggtgttggcaccgtggaaggaaagtgaacagtgttggagatctgggacagatgtgatattaatacaggatccatttcttggagtgttttccaactcttattccaagtggacacccagaaacatcccttttaaatgttaatggggtttttattgacggtataaaggttaagagcttgcgaaagatacaattgtcagtacactccttccagttccggaggccgccagtaagtggcagtctttccctgtcgctggctgcaggtcacccttggcctcggtggaacttgtgtgggtcattctcagtccatttgaaagttgggcctgttcggttgtgtataattttctgttcatcatttttctggcaatctcaggacagaagtcctctgatcctcctgtgagaagtaaacattaatgttattagattctttttttttttttttgagtttcgctcttgtggcccaggctggagtgcagtggcgtgatctcggctcactgcaacctctgcctcccggtttcaagcgatttcctgcctcagcctcccgagtagctgggattacaggtgcccaccaccacgctcgcctaattttttgtatttttagtagatacggggtttcaccatgttgtccaggctggtcttgaactccctacctcaggtgattcatcaaccttggcctcccaaagtgctgggattacaggcgtgagccaccgcacccgggctgttattagacttggaatgggacaaaagtcatatgagacagacttgtttgctgaggtatttaaaaaacaaaatggtctaagatggcagattcttggggaactctgctctgtgcacatttctgcctattaaagtggccgtaaaaacaaccataaatccttgatgaggacacctcaggagctttaggacggtgccattcttttttaattaaaagctttttatttgatttgatttttctgtagagacagggtctcggctatgttgaccaggctggtcttgaactcttggccttaagtgatccttctgcctcaacctcccaaagtgctgagattataggcatgagtcaccacacctggccagggcagtgccattctaaggcaacggcttcaactcggtcttcttttctggggttacaggagatgggaagggccgaaggtagcatgagaacgtgtgtgtgtgtgtgtttgtgtgtgtgtgtgtgtgtttgtgcatgtgtatgtggaaggactggtgagatggctggaggaagaggcagtccttctgcttaactctaatggcctaaatgtgagaaacaaagattcaggaaataaggaaaaagcaaatgagtgattgcctctctggatcaagcacaccagcaggcacaaccagcctttcttgagctactgtgtgccgggcgctgtgccgtgcccttgcatgcatgtggatgcttcatgagttcatgaagtaggtatgcttccagccccatttttcagagaaagaaactgaggctgaacaatcttgcagctgtcaagtggcagagcaggggtttgaacccaggtccaagagttcttaaccaccatgttttcctgcccttgatgtatgaaatgagatgatgtagtcacatgccagcttgtctagggatgactcagaggtttagagatggatgtcacgtggatgttgtacaggagaggcaggtataagctgtagtaaagttaggaaaggcacagtgacgtggagcactgtgtgcagtggacggggtcatggctgggggtgagaatggtggaggaccttcgattatttcatcagcgttgtttctgtaaccaaagagctgcatgaccaaaccctgagatctagttccttaataggaacaattattcggcacgattccctttacttaaaagcaggggccgtcctaagggaggagttggaaagagtttgggggataaggtttgcttggttgccttctgtttaggctgatgttcagtgggggtcaaaggctgtgtgtccagtccctggcatgtggcgggtgtttgtggtacacagccagcctcaggatggcccccagggatgcacactgcctttgtgtgtggtcccctcccacactgaatcaggctggctctgtgcgaccagtgggaagtggtggaagtgagtgatgatgtgtgacttctcgggctaggtcgtaacaggcattgcactttggctctcgggaagccaactgccttgcgtgagggtgctcaggcagcctcgtggggaggggtgaggcccctggcccccagcatgtacagcttgccaccacgtgagtgagccagcttggaagcgaatttccccgccccggtcaagccttctggtgagtgcaactgcagatgacatctgacttccaccactcaagagaccccaggtcagtgctgcccagctgagctcttcccaggttctttatgtcccccgaaaatgagctgttttaagtttagaaaacttaaaaacacagtgacaatgaagcacagatatgcattacatacagtcccaaatcagtaatgacttcaagctgtgtcctctctttccaagaaagacaaagcagagaacaaagttcaacctacagtgtcttcccaaattcttgacccacgggatctgtgaatatcttatacgactgaattaagcctctaagttttggggtaactcatgcaacattaggtaactggaatagtgctcaataaatgtctgtcacatgaatgggcagtgaccatggatgcatttctagttgtgtattagttaaggctctcttggtttcaagtaacagaaatccaactccaactagcttgagcaaaatggggcattcctctggtcaagtaacggagaaatccaagagtctctggcttcatgcatagcgggacccagtctcaatttccacctcctggctctgcttcccttgatgccaactttcaggaatcagctttctgaaagaccactctgctagaaacagacaggcccatcctttcaaccaggtccaggactgtttgctcagtcactgctctcagaggcaggggcagaggcagatgccgggcacacatccacagaagtggagatggcaggaaactgagagtggagtgctggaaagctggcttttgcctatgggttccgcttctgacatcatccggcaatgtcaggctttacattgcccccatctgcagacccagcagaaggacagcttccatcccaccacatcaatatgccagtcctggggcgggggaaggacttatgggcaacctttgcagaatcactggggcctggccgcacatgagccatgcccacgctcatgtgacaggcggcccctgtgcctggggtgctgtattacccagaggaataagtgatcctgggtgggcaaaagcaacagaagagaagtcagctccacttccttccaaaacttgagaaggcctggtcaaaatcaccctccaggcccggtgtggtggctcatgcctgtaatcccagcactttgggaggttgagatgggcagatcatgaggtcaagagatcgagaccatcctggccaatatggtgaaaccccgtctctactaaaactacaaaaattagctaggtgtggtggtgggcgcctgtagtcccagccactcgataggctgacaggagaatcacttgatccagggagtcggaggttgcagtgagccgagatcgcaccattgcactctagcctggcgacagagtgagactaaaaaaaaaaaaaaagaaaaaagaaaaaaatcagcctccatttttggctttctctttcattagaaaaatgaacctgactttatgaccatgacaatgaaatgcctagagaagggagcactcattttccagtgggcctactgtgtgctggggtggcgagactcttcctgccctggaacttggtgaggtcaggagggaagatattatatgactgccttcctctgtactttttcagtgggggcaggtgtttatgcttgatgatgcaatggtgagatcttggttggaatatgaacttttctttctttttttttttttagatgggttcttgttctgttccccaggctggagtacaatggcaccatcacagctcactgcagccttgatctcccagggtcaagggatcatcgtgcctcagcctgctgagtagctgggactacaggagtgcaccaccacacctggctaatttttttaaaaaaaatctttgtagagatgagctctcactaggttgcccaggctggtcttgaactcctgagctcaagcaatcctcccaccttgggctccctaagtgttgggattacaggcaagagtcaccacgcccagccaggatcacagacgtttaaattacactccttctgctgtgccttacagcagtagaaggggtgaaatttaaacgtctgtgatcctggggttgttgaagatgccacccatctacatattctttcagatgcacaatatttcactgtgtgaatgaaacagcagcccttcttacgtgtgctttttggaatttgaagattttgtaagataagatgaatgcattggaacaagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcatggaatgagtaattattacagtggagaactcctcactgtgaattaattacacagatgatattcaagacttagactgggctagtgcaggggttagcaaactatggcccactgttcttgttttataaataaagtgttatgagcacacagccatgcccattcatttgcagattatggctgcttttgcctgacagtgccagatgtaagtagttgtggcaaagaccaggtagcctaaaaagcctaaaatacttgctatctgggtctttacagaagacattttgttgttgttgttgttgtttttgagatggggtctttctctgtcacccaggctggagtgcagtggtgtgatctcagctcactgcaacctccgcctcttgggttcaaatgattatcgtgcctcagcctccctagtagctgggattataggcgcctgccaccaagcctggctaatttttgcatttttagtagaaacagggctttaccatgttggccaggctggtctcaaaccccgacctcagatgatctgcctgcctcagcctcccaaagtgctgggattacaggtgtgagccactgcgcctggcctagaaaatgttttctaacctgttgtctagtgggtgctttgtaaagtttagttttagggggagcatcattaattcattcaacaagtattaactgagcatctcccctgtgctgggtgctgcttggcatactgggggtttagtggtgtgagagagaccgagcctcagctcttaggagcacagtgctgatggaggacgaaaggtaaacacacacattagaagttgttggataatgccaggcgttacgaagaaaagaagcagaacaaggcaatgtgacagaggatgattggtatcatggaaggtctctctgaggaggcagcatctgagctgagacctgaggaggggaagggccagttatgcaaagatctgggggaagagctgcccaggcagaggggaccataattgcaaaggcccccaggaggaaatgagctccctgagtttcaggaatagcaaagaggccagggtggccagagtcaagtgattgagaggaagagatgagaacgatggcagggaccgggtcatgtgggtgccctggaaaggagtttagattttattctaatggcaacagaaggcattggagggtttaagtagggaaaggggagtgatctgatgtatgtttttaaacaattgcttctttaaattttgaggagattggattattgggaagcaagaatgaatttagggagagaagcaaagaggacgttgtgttggtttaggcaaaagacagcaatggcttggattggggtgatggaagtaacagtggcaggaagtggtgagcttggggctatgcttcagagatagagcagaaaggtcttgctgatgtatttaatacaggaggtgagggaagggaggaatcaacgataagtgaatcgtttgtttctagctgaaccactgaaatgtgtaggtaaattgagacttctgttttggccatcgtgagtttgagatgcttatcagacacccgagtctgcagcctgggtgagaaatcacggctggagatgagacgtggtgagctgggagtgtttttggatgacagatgaggccacgggattgaataataggtatccttatgaagactgagaaaaggagagggctgggggccaagccctgggacagtgcaaccttcagaggatgggcgaggagggccctgcccaagagacagagaggaagtggcccgtgaggtagggggaagtccaggagaggacagtgtggtgaatacctaatgctttactcattcactggtgaatgaatggatggatggatggatggatggatggatggatgaatgcatgaatattccttaataatatggttggccatggtccatccatatgactcctacggacaccatgttaccatttcacactcgtcttctatttaggagaaatcagacgaaactgccatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacattactaatcctggctgtcagcgaagagagcctagaagcaaggataccccagtagcaacaaacctctggtgcccaggtctctgttctccaataaacaccattctccagtaaaaggaaccaggcttcttgaacaaatgtcgatcctaggaccgagggaggaaatagataagaagaacctgaagcatcttgtagggtcacagggtgaggaggcgctaaatgaaacaaaatgaaactgctgcagtgatggggcatctcagagggacacaggagccagtggaaaagctcccaggggtcaaagccagaacaatttgagccccaaaaaagtactattggattagaattcaaagaataaatacccatgattccatactgctataaatgatcagataagagagaagagacaaatctcccaggcagaagaattccagattatttatttatttttatttaattttttttttttacacagggtcttgctctgttgcccaggttggagtgcagtgatgtaatcttggcttactgcaacctccacctcccaggttcaagcgattcttgtgcctcagcctcccgagtagctgggatcacaggcatgcgctgccacactcggctaattttttgtatttttagtagaggcggggtttcaccatgttgaccaggttggtctcaaactcctgacctcaagtgatcaccctcctcggcctcccattcaagtgctgggatgacaggtgtgagccaccgtgcccggccccaggtaatttatatagctattccatcgtcaaggaggtggagcggacttcccacatcctaagtgtgggctgtgcatagtgactctcttccaaagagtacagtgtgaaaagagaggagagagtaactttacagtggagaacacggacagactacctcagccaggtgatcaaagtcaacttcaatagcggcaagtcatcttgagagaatgcgtgcctgatacagagtgctgagaatgattcttaagctctgtggtcctcctcctcaaaacacacacaagccaagactaaggatgagaagcatctgccaaatcccagttgaggaacattctacaaaatacctggccagcactcctcaaaatgctccatgtggtatcctggaacagaaaaaggacattaagcaaaaactaaggcaatcagaatcaactatggactttaggtggccaggcacggtggctcgcgcctgtaaccctagcactttgtgaggccgaggccggcggatgggttgagcccaggagttcaagaccagcctgggcgacatggcgaaaccccatctctacaaaaaatacaaaaaattagccaggcttgtggtgtgcacctgtagtcctagctactcgggaggctgagatgggaggatcacttgagtccgggaagtcaaggctgcaagtgacccgtgattgtgccactgtataccagcatgggcaatgagagtgagaccctgtctcaacaaacaaacaacaaacaaacaaacaaaaacaaattctctggggatggtagcaggcacctgtatttccagctacttgggaggctgagatggaggatcgcttgagccaggggaggtggagggttgaggctgccatgaactatgatcacaccaccacactccagcctaggtgacgagcaagaccctgtccccacccccctaaaaaaagtatggactttagttcataatgcatcaagctatggggtacatggaaactctctgtactgctttcaccatttttctaaaactgttctaaaataaaaaatttacttaaacatttatttaaaaaaaaaaacaaaccatttgagtaccaacagtgtcatatgctcaacttagcacatctttttcctggtttggtttgtgggcgtgaatgtgtactgagccatctaaaccttggttgcccgaccttcaccgtagccactgacccaggttaacagacaaaaggcccaggttaaggttatgcccagtggccataaaatagcccagcatccagactgcactccttgatgtacccaaaaaagccaaggaataggacggatgggcggggagtggggggcaaactactgcccattgcccaactctggccagctgtctgttttataaataaagttttattggaacacagtcacacccattcatttattatcatctatggctacatttgcatgacaatggcagtgttgagtagttgcaccagagatcgtgtggcccacaaaatatttattatctagcactttacagaaaaagcttgtcaacctccaggacagtggccacaagttctgccatcatctcatcccttagcaagaagggaaaggaatgcccattaaggcacaaattgttttctgttgttgtttgtttgtttgtttgtttttgagacggagtttcagtcttgtcgcccaggctggagtgcaatggcgtgatcttggctcactgcaacctccgcctcccaggttcaagcgattctcctgcctcaacctcccgagtagctaggattacaggcgccagccaccacatccagcaaatttttgtatttttagtagcgacggggtttcactatgttgaccaggctggtctcgaactcctgaccgcaggtgatccacctgctttggcctcccaaagcgctgggattacaggtgtgagccaccgtgcctggccacaaggtggtcttttaacaacagagcacacagctggacaaagcccaacgctctcttctttggggccgaggtgggtcattaatattgaacatttacaatgtacttgctccaggtgattcagtttaatttctgccgtctcttgtaacagggctcccacgtgcacgggttggggccgtgtgtctgcctctgctttctgaggccccacagcgtattgattctgcgaaacgtacgtttctttgaaaacagcgtctcttgacatgacaggagatcacacatcgcttgttttctgtccctttcattgccctctgaacatgataaaatcatgacctagtgtcaccgagggacctcagcatctcttggaaagaaggacttgccttcttttttatctttgtcaagccagtgaggccaagtagaaaatttttagcagctttggagccagacagatcggagtgcgagttctgcccgttattgactggaccgtgtgaccctgggagagccgcctagtgtctatgagacggaggctgttgggcaagaaaatggggatggtcccagcattatggggcggttgtgagaattcagtgcaatgatgcagtgctcccagaacagctggtctagggcttggctcatgggactgtcccttcgcagaggcagcgtggacattccgctggtatccactggtgtggctgtgcctgtttggtcaccgtgtctgttctgattggtcggtgctcctgcatgtcaagagttcaatgttatgaaaatcatccctgcctagagatgaattcccccttcccctgaggtctagactggtatagctgcttttggagcctcacctgctgagagctcacagctgtccttctctagagaatcaccctcagatgggagccacattgcctgggatgggatgccatgcccagtaatggcccagtgactaactgatacagcaacgtgaatggctggtccctgccccacggtggggacgatcctgtggcgtgctctctgctgctcgtgggataggtcaaggcgggactttaagggaccacattctcactctgctctgtccccttctgcatcctgtagtcctcacctcccttctcctgaaagcccctttcaaaacaaaaacaaaaaccacatccacccaagtccctgtctccagctctgcctccaggaaagccggcggaaggccgccagtctcagctgtgacagatacagatatttctgcatttccaggactgaggtcaatccctggggacccagtgaggcggtatctgaagggccatggagctggcttgatggggtctacaggtaggcagggacctggtggggatgtgactcaaggatttttatcaaatatctttatcccctgacagatgcaaaaaaaaaaaaatgagatcagactccagggtttcctccatgccacactgtggccccattgtttgttgtgctatcagcagaagttgattttgcaaggaatgtacacgtgtatgtgatgtttgaatgcacctatctgtgtgtgcgtgcatttgtgtgtgtgtgtgtgcattcgcttgtgtgtgtgtgtgtgtgtgtgtgtgtgtgtgtgtgtgtgtgtgtgtgctgaggatgtgagccccacttccggcccagtgcccctgcccaggctggctctgccctcctgctgctctgggcccctcaggcagtgactacctggtacatagggaaggcatcagcatcccttattcatggggactgtatactgtctccaccatattgggccttttggcctcttggacatgacttggcctctgctggctttaagggactgccagagatgccatcttctctgggaaatgttctcagcctgggcacagcccactaaccactgcctgcttgtctgagacttctctgtccaggaaaacagcccagcctgaccagagatgggcatagagccatattttgggaaagactggttgggggtcaacttggtttctggaaccagttctgatttcagttgcaggggacagtgagccagttactgcccactggctgcatcctaagccttcctagaggagagctagcctcctcctagggttgcccaggctggaccacttctgcctgggtgatgggttgggagaaagacgttaatatttggagcagtgttatattagtcagccctcccatttgcaaacattagaaaaccagctcaaattagtgataaaagaaaatctcagctgaattaaatttaaagtagtttaattgagcaatgaatgattcgcgaattgggcagaccccagaatcacagcagattcatagagactccagcgcagccacgtggtggaagaagatttatggacaaaagaagggaaatgatgtacagaaatcagaagtgaagtacagaatggctggattgttacaagttggcgtttgccttatttgagtacagtttgaacactcagcagcgtatgagcggttgaactacggcctctgggattggccaagactcagctattgttacaggcgcatactcctaagttaggttttcaatcttgtctacctattaagctaggttgcaatttgtccacaaggactcaactatagaagtacgaagtcccactcaggccatatttagttcactttaacactagcttcggcaactgtctctcagagcccagggcagggcagggatgcaactgggcttcaggaaacttgaattcattgactgtctcttccccatcttagatgcagtgctaagggctttttagtaattttctcatttgactctcaaaacaaactgatgaggaaacggtctgagagtagttaggcagcttttcaaggtcacacagatagtaaatgtcatcactgggacttgaactcaggtctttctgactctcatgtctgtgcaacatgtcatctcagccactgttgacactgtatatgtggattagggttggctaaactgctgtaacaaatagacccaactcgaatggtgcatgtatgtacaataggggtttatttcttatgatatagttcacggtggtcccaggtgaataaggatgggtaggtctgcatttttcataatcatctggatttctgctcaggctcctagagtctctgccaccttccccatgtggcttccaaggccaccttggagacagagcttggtggagcacatgtggtaggattttttttgtttttttgagacggagtctcactgtattgcccagtctggagtgcagtggtgcaatctcggctcactgcaacctctgcctcccaggttcaagctattctcctgtctcagcctccctagtagctgggactacaggcacctgccaccacgcctggctaatttttgtatttttagtagaaatgggatttcaccttgttggtcaggttggtctcaaactcctgacctcaggtgatccacccacctcggcctcccaaagtgctgggattacaggcatgagccaccactcccagccagttctttttttcttttttccattttttttttttcgagacagggtcttactctgttgcccaggctggagtgcagtggcacaatcacggctcagcgcagccactgcctcctgggctcacacgctcctccggcctcagcctctcgagtacctgggactacaagtgtgagccagtttggctaattttggctaatttttgtagaaacggggtctcgccatgttggccaggctggtctccaactcctgggctcaagggatccaccttcctccccctctcaaagttctgggattaccggagtgacccactgtgccctgctggcaaatttcttaaactgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctcttagccaggaaacctggggtagggaggcttggagccagcgggtgcgtcgggaggctgcgggtactgactggggacgcgcacggagattgcgggagaaggatccacgccgcgggagaaggatccatgccgcgggagaaggatcagagtggagcctgtggctgctgcaggaggaggaagccgccgcctggcccacaccacaggagaagggcggagccagatggcaccctgcccaccgcttcccgcccacgcactttagcctgcagaggggcggagcgtgaaaaatacctcgtgcgcctcggccgactctacagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcggcacagcggccctgctaaataaggaacgcctggagccgcggttggcacggccccggggagccgaaaaaccccgggtctggagacagacgtccccacccgggggctctgcggacgccagcgggggcggggcgcggaggccgcgctcagctgggaggacaaacagtcgctaattggagaggaattgggattcggcctggggctgcggggtacccggagagatggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggctttctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggaacccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaaggatgctgccgagaggtggtggcttttggaaaagatggcgtactgcaaaacgtgctgctctgcatggctcgaagcttcgtggggagacgtgggcagagccgtggctgactcacagaccccccaccccagagcctgccctgccctccctgccccgacccttcccctcctgacccatgtgttttttgtttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaataccgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagtgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatacttttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtatatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtcttgatctcttgatctcatgatccacccaccttggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctccgctgtgctccctggtagcctggtagtgagcctgcttctcacacagtcatacctggttgtggtcccacagtgggaccaccctgttgggttcagaacaggagatgggggcccctcgagtctgtgtgggggctgtagacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggcccccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgttctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcaggacggcctctcagccccgcacgagcccgtggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagtgcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcctttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccagctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcggcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcagtgccaccatgctgggtacatgggggacagggctgttccatcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagcgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccacacatacgtctgttcccacacgcatccccccaggggccctcagtgagcattgcctgcctcctgccagggtccagctgggtccagtacaccagaacgcacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgctctcaccaccaaggtgcacttcgaatgcatgggtgagtgcaggcctgcgtagggggagcagcgggatcccccgactctgtgaggtcacggagccctcctgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccaggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctcatcccgctgagcccctccactcctcccccagcccctccatcccctcacccctcccctcctccttcctcccctccctctcctctcccccttctctctccttccctctcctctccccccttttctccacttccctctcctctctcccttctgccctcctccttctctcatgtgaagaggtgccttgtgtggtcagtgggctgcatcacgtgttccccaggtggaggccctgggtcatgcagagccacaaaaaatgcttagtgaggaggctgtgggggtccagtcaagtgggctctccagctgcagggctgggggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatcccccttatccccttcccctccctttcaccctgctcctcttcttctcccctttctcttttctctacccttttccttcctttttcctccctctccccatcatccccctcatcttcgtcctcatccccatccccttccccctccccctccaccactctctctccagcttccctcttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcgtcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctacacagtagcgtagccccacaagttacgtgagcatcgctaccactgtgggagaccatgcatccacccgcgatcctgactgcatagctcgtctctcagacggaggcgccagcaccctccccgtggctgtttcttcaatacctccattttcctttctttggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggtgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggtgtggacaggtgtgcagtgcgggtcactggttgtggtgtggactgaggcgtgtgcagccatgtttgcatgttacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcatgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcggagctgtttcactcgcatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcatgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccagcaggggttgctcccgagtccgtggcaggaaccagaggccacatgtggctgctcgtatttaagttaattaaaatggaacgatggccgggtgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactccagcctgggtgacagagcgagactccatctaaaaaaaaaaaaaatgaaatttaaaactctgttccttagctgcaccagtctgctgtcaaccgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgcttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgatatagataaggacatcatcactcggtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggtttgtgaaggttccagagaggacctggccttgggaggagcgtgggggactgagaagggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctcctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatcgggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttatttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtccggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatgacaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggcctggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagtgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctcccgagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatatttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggttatccgcctgcctcggcctcccaaagtgctgggattacaggagtgagccaccatgccagcctcatgtcattcttgtgtgttgtgtgtgtgtgtgtgtgtgtgtgtgtgacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaactgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggtgtgagccaccacacccaggctttttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcagggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccaaattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgctgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgatttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacggggtttcactgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcctggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagactttgaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattacctcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgcagtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgcgactacaggcatgtgccaccacgcctgggtaatttttgtatttttagtagagacagggtttagtagagaccatggtgaaaccccgtctctattaaacaaatctctactaaccccatctctacaaaaatcagctgggcgtggtagtgcacacctgtaattctagctacttgggaggctgaggcacgagaatcatttgcatcttggaggcagagtttgcagtgagctgacatcgcaccactgcgctccagccgggatgacagaacaagaccctgtctcaaaaaaaagaaaaaggaacaaacaacagcaacgacaacaaaaaaacctctgtgtcaatcacagccttcaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgcacgcgcgtgtgtgtgtgcacgcgcgtgtgtgtgtgtgtttaatatagagacagggtctcactctgttgcctaggctcgtttcaaactcctgggctccagtgattctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatcttagctccctgtagccttgacctctctgggctcaagtgatttttctctcctctacctcccgagtacttgggaccacaggcgcatgccgccatgcctggctaatgtgtatttttttgtagatacggggtctcactgtgttgcccagggtggtttcaaaatcctgggcccaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcctggcttggtttccccagatgagtgttcatttgggtcttccatcagaaaggcccctcctgacctctgggagtggggagctcaagggtgggaggccttagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcactggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggccaccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgtgttggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccgggtcaccaggtgcctgcccccaccccccgaggggccataggttgggagatctctgaagcagtggggcagagcctgtggctggggagtctcaggaggagggaggtgggagctgggccggccctggtgagcaggtggcgccggccggtggggccgttcctgtcagctctgcagatgcagaggtggacacgagctgggggcagcctccggacactcctgggcacgccatacgggaggtggcctgcacggggatccctgccagtgcccacaggcctcgtgggtgggtgctgctgtgagcctgggctggtgggccctgctctccgggctctgagcctcagtttccccatctggaaagggggacagtgacggggctcccagtgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgctgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgcagggacccctgatgcctctggcacggcagtacggcctctcagccccgcatgagcccgtggaggtagtcggccccccacgttctaaaacctgccctcctgcctgcccctggaggcctcgcctgccctgcccactgtgggtctccccaaaaaacttgggggccttaatgttgcttgtgcccagtgaagatggttgggaaaatccagagtgcagagaggaaagcgtttactcacattacccccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccgtgggcgaatgagggccccaacaccctcccctcctcgcagggaccccggagaacggcagcgagcctgagagcaggtccccggacaacaggacccagctggcccccgcgtgcatgccagggggacgctggtgccctggagccaacatctgcttgccgctggacgcctcctgccaccccaggcctgcgccaatggctgcacgtcaggggccagggctactcggggccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgccaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcatgaaatgaatttaaaactctgctccctgacctcacacgagcccccgtgagtctctcacgccctctgctgtgttctcacctggctaaagcgagtggcttttgaggtggagtctgaacccctgatgggaaactgcgggctgcccgcggtgccaccatgctgggtacatgggggacagggctgtctccgtcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctcccatggcatgcagagccccggccacctcctctcctctgtgccccgcgtgggactctccagcctgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggggtggggaggggaggggatggggtggggcggggcgggctccaccttcacctctgcttcatgctgcccgaggacgctgccatggctgtgggtgagtggagggagggacgctaagcagggccaggcctctcacctgccacctgggcccactgatgcctatccctgcagctgacggcctccaaccacgtgagcaacgtcaccgtgaactacaacatcaccgtggagcggatgaacaggatgcagggcctgcgggtctccacagtgccggccgtgctgtcccccaatgccacgctggcactgacggcgggcgtgctggtggactcggccgtggaggtggccttcctgtgagtgactcgggggccggtttggggtgggcaccaggctcttgtcccggccccagcctcagccgagggaccccacatcagggggttgcttttctgagcctcggtttccctatctgttgggaggtactgggtgcacaggagccctgaggctgcacgggagccgggagaggcctcagcacagccgggtgggccctgaatggaggcctggggcgtgactgcagagtggagcctcagctgggtcccaagcaccccctgcccccccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacgcacacctacgctgccccaggtgagggatgagggggtgagggggccactgcctttcaggctctgagcacggggcacccccagtcccccagtcaagctgccccccttcctccccaacagccctcactgtgacctcacctgggctgatggcttaggtccctactggggtgagggaggggccaggcgtggggggagtggacagggaagctgggccccctgaactgccccccgccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccgtgctggcatctaatgccttcgagaaccggacgcagcaggtgcctgtgagcgtgcgcgcctccctgccctccgaggctgtgggtgtgagtgacggcgtcctggtggccggccggcccgtcaccttctacccgcatctgctgccctcgcctgggggtgttctttacacgtgggacttcggggacggctcccctgtcctgacccagagccagccggctgccaaccacacctatccctcgaggggcatctaccacgtgcgcctggaggtcaacaacacggtgagcggtgcggcggcccaggcggatgtgcgcgtctttgaggagctccgcgggctcagcgtggacatgagcctggccgtggagcagggcgcccccgtggtggtcagtgccgcggtgcagacgggcgacaacatcacgtggaccttcgacatgggggacggcaccgtgctgtcgggcccagaggccacagtggagcatgtgtacctgcgggcacagaactgcacagtgaccgtgggtgcggccagccccgccggccacctggcccggagcctgcacgtgctggtcttcgtcctggaggtgctgcgcgtcgagcccgccgcctgcatccccactcagcctgacgcgcggctcacggcctacgtcaccgggaacccggcccgctacctcttcgactggacctttggggatggctcctccaacacgaccatgcgggggtgcccgacggtgacacacaacttcacgcgtagcggcacgttccccctggcgctggtgctgtccagccgcgtgaacagggcgcgttacttcaccagcatctgcgtggagccagaggtgggcaacgtcaccctgcagccagagaggcagtttgtgcagctcggggacgaggcccggctggtggcatgtgcctggcccccgttcccctaccgctacacctgggactttggcaccgaagaagccgtccccgcccgtgtcgggggccctgaggtgacgttcatctaccgagacccaggctcctatcttgtgacagtcaccgcgtccaacaacatctccgctgccaatgactcagccctggtggaggtgcaggagcccgtgctggtcaccagcatcaaggtcaatggctcccttgggctggagctgcagtagccgtacctgttctctgctgtgggccgtgggcgccccgccagctacctgtgggatctgggggacggtgggcggctcgagggtccggaggtcacccacgcttacaacagcacaggtgacttcaccgttagggtggccggctgcaatgaggtgagccgcagcgaggcctggctcaatgtgacggtgaagcggcgcgtgcgggggctcatcgtcaatgccagctgcacggtggtgcccctgaatgggagcatgagcttcagcacctcgctggaggccggcagtgatgtgcgctattcctgggtgctctgtgaccgctgcacgcccatctctgggggtcctgccatctctttacaccttccgctccgtgggcaccttcaatatcatcgtcacagctgagaacgaggtgggctccgcccaggacagcatcttcgtctatgtcctgcagctcatagaggggctgcaggtggtgggcggtggccgctacttccccaccaaccacacggtacagctgcaggccgtggtcagggatggcaccaacatctacagctggactgcctggagggacaggggcccggccctggccggcagcggcaaaggcttctcgctcactgcgctcgaggccggcacctaccatgtgcagctgcgggccaccaacatgctgggcagcgcctgggctgactgcaccgtggacttcgtggagcctgtggggtggctgatggtggccgcctccccgaacccagctgccgtcaacacaagtgtcaccctcagtgccgagctggctggtggcagtggtgtcgtatacacttggtccttggaggaggggctgagctgggagacccccgagccatttaccacccacagcttccccacacccggcctgcacttggtcaccatgacggcagggaacccgctgggctcagccaacgccaccgtggaagtggatgtgcaggtgcctgtgagtggcctcagcatcagggccagcgagccgggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttcaacatccggctcaatgcctccaacgcagtcagctgggtctcagccacgtacaacctcacggtggaggagcccatcgtgggcctggtgctgtgggccagcagcaaggtggtggcgcccgggcagcttgtccattttcagatcctgctggctgccggctcagctgtcaccttccgcctgcaggtcggcggggccagccccgaagtgctccctgggccccgtttctcccacagcttcccccgcatcggagaccacgtggtgagcgtgcagggcaaaaaccacgtgagctgggcccaggcgcaggtgcgcatcgtggtgctggaggccgtgagcgggctgcaggtgcccaactgctgtgagcctggcatcgccatgggcactgagaggaacttcacagcccgcgtgcagcgcggctctcgggtcgcctacgcctggtacttctcgctgcagaaggtccggggcgactctctgttcatcctgtcgggccgcgacgtcacctacacgccgtggccgcggggctgttggagatccaggtgcgtgccttcaacgccctgggcagtgagaaccgcacgctggtgctggaggttcaggacgccgtccagtatgtggccctgcggagcggcccctgcttcaccaaccgcttggcgcagtttgaggccgccaccagccccagcccccggcgcgtggcctaccactgggactttggggatgggtccccagggcaggacacagataagcccagggccgagcactcctacctgaggcctggggactaccgcgtgcaggtgaacgcctccaacctggtgagctttttcgtggcgcaggccacggtgaccgtccaggtgctggcctgccgggagccggaggtggacgtggtcctgcccctgcaggtgctgatgcgacgatcacagcgcaactgcctggatgcctacgttgacctgcgcgactgtgtcacctaccagactgagtaccgctgggaggtgtaccgcaccgccagctgccagcggccggggtgcccggcgcgtgtggccctgcccggcgtggacgtgagccggcctcagctggtgctgccgcggctggcgctgcctgtggggcactactgctttgtgtttgtcgtgtcatttggggacacgccactggcacggagcatccaggccaatgtgacggtggcccccgagcgcctggtgcccatcactgagggtggctcctaccgcgtgtggtcagacacacaggacctggtgctggatgggagcgagtcctacgaccccaacctggaggacggcgaccagacgccgctcagtttccagtgggcctgtgtggcttcgacacaggtcagtgcgtggcagggccgtcctccctgcccctcacccgtccacacccatgagcccagagaacacccagcttgccaccagggctggcccgtcctcagtgcctggtgggccccgtcccagcatggggagggggtctcccgcgctgtctcctgggccgggctctgctttaaaactggatggggttctcgggccacgtcgccccttgttctcggcctgcagagggaggctggcgggtgtgcgctgaactttgggccccgcgggagcagcacggtcaccattccacgggaacggctggcagctggcgtggagtacaccttcagcctcaccgtgtggaaggccggccacaaggaggaggccaccaaccagacggtgggtgccgcccgcccctcggccacttgccttggacagcccagcctccctgctcatctactgttttccgtgttttagtgctggtggaggccgcgcgctctcccctctctgtttctgatgcaaattctatgtaacacgacagcctgcttcagctttgcttccttccaaacctgccacagttccacatacagtcttcaagccacatatgctctagtgacaaaagctacacagtcccccagcaataccaacagtgaggaagagccccttcccaccccagaggcagccactgtccccagcccatgtccctgttgctggatgtggtgggccggttctcaccctcatgctccccactctggaccggccaggaggcttggtgaccctgagcccgtggtggctgctcctgctgctgtcaggcggggcctgctggtgccccagagtgggtgtctgttccccagtccctgctttcctcaacgggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgccagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgccctcaccaccaaggtgcacttcaaatgcacgggtgagtgcaggcctgcgtagggggagcagcgggatcccccgactctgtgaggtcacggagccctcccgtgatgctgtggggaccatccctcaggctggcatgacgcggaggatgctggcgccccgctggtgtatgccctgctgctgcagcgctgttgccagggccactgcaaagagttctgtgtctacaagagcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcaccggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctcaccccgccccgcatgcctgccagggtactgggttcagccccccagggcagacgggcagcttggccgaggagctgagcctccagcctgggctccttcctgccgtggcgttcctcggtctctgacctgcttcagtagcctcagcctttctgctgtcctgtgtgaacgcagggtgcctctcgggggacccagggtgtaaagaggggcccagatgtggggagggactaagaagatgctgctctgtgccctccactctcccctcccctcccccttccctcccctttctccatctctctccccttttctccatttcccccccgatcctccccgtccttttgtccattcccctcatctttcttatcccccttatcctccttcccctcccttatcctccttcccctcccttatcccccttatcccccttcccctccctttccccctgctcctcctcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagcccccaccctccagctccccctttttgcctgcccccaccctccctctgcctccctgtctctgcactgacctcacgcctgtctgcaggagacctcatccacctggccagctcagacgtgcgggcaccgcagcgctcagagctgggagccgagtcaccattgcggatggtggcgtcccaggcctacaacctgacctctgccctcatgcgcatcctcacgcgctcccgcgtgctcaacgaggagcccgtgacgctggcgggcgaggagatcatggcccagggcaagcgctcggacccgcggagcctgctgtgctatggcggcgccccagggcctggctgccacctctccatcccctaggctttcagcagggccccggccaacctcagtgacgtggtgcagctcgtctttctggtggactccaatccctttctctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccactgcagctccgccaactccgttgtggtccagccccaggcctccgtcggtgctgtggtcaccctggacagcagcaaccctgtggccgtgctgcatctgcagctcaactatacgctgctggacggtgtgtgcagcgggtggggcacacgcggccccctggccttgttcttggggggaaggcgtttctcgtagggcttccatgggtgtctctggtgaaatttgctgtttcatgggctgttgggggcctggccggagaggagctgggggccacggagaagcaggtgccagctctggtgcagaggctcctatggcctttcaggcccgtggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgtgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggatgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcccggcggctgtgtcttcacaggagccgacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcagacggaggtgccagcaccctccccgtggctgtttcttcaatacctccattttcctttattggaattgcccttctggcattccctttttgttttcatttttctttttttggagacggagtctcactctgttgcccaggctggagtgcaatggcgtgatcttggctcacagcaacttccagctcctgggtttaagcgattccccttaagcgattctcctgagtagctgggagtacaggtgcacgccaccacacccagttaatttttcaccatgtcagccaggcgaactcctgacctcaggtgatccgcctgcctcggcctgccagagtgctgggatgacaggtgtgagccaccacacctggctgtgttcccattttttatttccgtgttgctttcatcttcatttcccagttcttttgattacctacttttaaaaactgtcggccgggcgcggtggctcacacctgtaatccgagcactttgggaggccgaggcaggcaaatcacggggtcaggagaccgagaccatcctggctaacggtgaaaccctgtctctactaaaaaatacaaaaaaattagcccggcgtggtggcaggcacctgtagtcccagctcctcgggagactgaggcaggagaatggcgtgagcccgggaggcggagcttgcagtgagctgagattgcgccactgcactccagcctgggtgacacagcaagactccatctcaaaaaaaaaaagaaaaaaaatactgtcacctgggtctgtcactgggagaggaggtgacacagcttcacgcttcgcagtctgtgcatgaactgagggacgggtgtgtggtgcgggtcactggttgtggcgtgactgaggcgtggacaggtgtgcagcgcgggtcactggttgtggtgtggactgaggcgtgtgcagccatgtttgcatgtcacaagttacagttctttccgtgtaacttaatcatgtccttgaggtcctgctgtttattggacaaattgcagtaaccgcagctcctcgtgtatggcagagccgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagtggccaccggcacctggacggcgacagagccttccaccgcaacagtctggacatcttccggatcgccaccccgcacagcctgggtagcgtgtggaagatccgagtgtggcacgacaacaaaggtctgtgcggaccctgccaagctctgcccctctgcccccgcattggggcgccctgcgagcctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggctgcgagtaaggcctcgttccatgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacaggtgggtgccgtaggggtcgggacagcctcttcctgcccagcccttcctgcccctcagcctcacctgtgtggcctcctctcctccacacagcacggggcatgtgtccaggctgagcccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaatggagcaagactccatctccaaaaaaaagaaaaaaaaaatcccacaaagaaaagcttgggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactcaggaggctgagccaggacaatcgcctgaacgcgggaggtggaggttgcagtgagctgagattgcgccagtgcactcctgcctgggtgacagagcgagactccatcttaaaaaaaaaaaaaaaatgaaattcaaaactctgttccttagctgcaccagtctgctgtcaagtgttcagtggcacatgtcgcgaggggctgccatcacggacggtgcagatgtcccatatatccagcattctaggacattctgttagatggcaccgggctctgtcctgtctgctgaggaggtggcttctcatccctgtcctgagcaggtctgagctgccgcccgctgaccactgccgtcgtcctgcaggtggctgggagcctgagccccacacctgccgggcagtaggtgctggacatcgacagctgcctggactcgtccgtgctggacagctccttcctcacgttctcaggcctccacgctgaggtgagggctctactgggggtcctgggctgggctgggggtcctgccgccttggcgcagcttggactccagacactgtgcacctctcagcaggcctttgctggacaggtgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacgtgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacaacccccacttactgggtctctccttttacaaccaacacaaccgaaatctagggcttctttttttttttttttttttttgagacagagtctcattccattctgtcacccaggctggagtgcaatggtacgatctcggctcactgcaacctccgcctcccgggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacaggcgtgagccaccatgcccagccaaatctagggctggaacatggctgcagcatataaatagaattgaattccatagttttgttaatcctgttttttgtttgtttgtagttgttgctgtttttgagacagagtctcgctctgtcgtctaggctggagtgcagtggtgtaatctcggctcactgcagactctgcctcccgggttcaaactgttctcctgcctcagcctcccaagtaggtgggactacaggtgcccaccaccacacccggctaatttttgtattttattagagacagggtttcaccatattggccaggctggtctggaactcctgaccttgtgatctgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagagagtttgggcacactctgtgtgatcgggcagaaggcctgtgggaagtttagctgaggacagggccaggaaaggtgatggacagtgggggtctgtcctggtcaccaggcccctgggtcctgcccgcctgcttggagctccccacccatcacacatgatgcggccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgacatagataaggacatcatcactcagtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtacaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaagtcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccctcccctccccctcccctccccctccccaactcagatccggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggcgctgttgcactcttgtctccaacagacaaaacggaccaaaacaaagtgaaatgtcatttgatttgtgtcatctggtttgatgacttttttttgtttgtttgttttttagacagagtctcactctgttgcccaggctggagtgcagtggcaagatctcggctcactgcaacctccgcttccggggttcaagcaattgtcctgcctcagcctcctgagtagctcagattaccacgcctggctaatgtttgtatttttagtagaccaccacgcctggctactttttgtatttttagtagagactgggtttcaccatgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaatttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtatttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccacagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattacttccttttcaagttgtgaaacatgttaacctgtggtaaaatacttacaagatgataattaccatctaaccgtgttgaagtgtacagttcagttgtgtgaagtatattcatgtcatttttttttttttttttttttgagacagagtctcactctgtcaccaggctggagtgcagtggtgggatcttggctcactgcaccctctgcctcctgggttcaagcagttctcctgcctcagcctcccgagtagctgggactacaggcgtgggccaccatgctcagctaatttttgtatttttagtagagacggggtttcaccatgttgcccaggatgatctccatctcttgaccttgtgattcacccgcctcggcctcccaaagtgctgggattacaggcgtgagctacagcacctggcctatttttttttttttttttgagacagagtttgaattttgttgcccaggttggagtgcaatggcacaatctcagctcaccacaaccttttcctgctggattcaagtgattctcctgcctcagcctcgcgactagctgggattacaggcatgcaccaccatgcctggctaattttgaatttttagcagagacagcgtttctccatgttggtgaggctggtctcaaactcccgacctcaggtgatccgcctgcctcggcctcccaaagtactgggattacaggagtgagccaccctgccagcctcatgtcattctttgtgtgtgtgtgtgtgtgtgtgtgtgtgtgtgtgtgacagagtctcattctgtcgctcaggctggagtgcagtggtgtgatctcggctcactgcaaactccgcctcccagcttcaaacggttctctgcctcagcctcccgagtagctcggattacaggcgcccactgccatgcccggctaatttttgtatttttagtagagacggggtttcaccatcttggccaggctggtcttgaactcctgaccccgtgatccacctgcctcggcctcccaaagtactgggattatacgcatgagccaccgtgcccagccgtcattcttatattattatttcctaggtgtctttcctgaagactatcttcccatctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaagtccatttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttcgacaatatttgtggcaaattcagtgggttcaaaattgagtttgtcctttctgcttcattagtttaagctgtataattcctttcccttcctacattcttgtttgtcattttttcaggggaagaggagttgctagtactgcattggttttcctttctctctcttttttttttttttttttcctgagatggggctttgctcttgttgcccaggctgcagttcaatggcacaatctcaactcactgccttttgggttcaagcaattctcctgcctcagcctcccaagtagctgggattacaggtgcccaccaccatgcccagctaatttttgtatttttactagatatggggtttcaccatgttgtccaggctgatctcgaacttctgacctcaggtaatccacccgcctcagcctcccaaagtgctgggattagaggcgtgagccaccacacccagcacccagcctttttttttttttttttaattttgagatagagtctcgctctgtcgcccaggctggagtgctgtggtgcaatcttggctcactgcaacctctgcctcccagtttgaagcaattctgcctcagcttcccgagtagcttggattacaggtgtgtgccgccacattcggccaattttttttttttttttttttttttttgagacggagtctcactctgtcacccaggctagagtgcggtggcatgatcttggctcactgcaacttccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacacctcggcctcccagtgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatggtttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacactccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaattgaaccttgttaaagtcagtcaacaccagggtggatggtttgccgttgtcacctattttcaggacataacaccctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgattttttttatccctcaatgggaggtgtccattctcccttcagttgtgagaatcagttggttcatttgtgggaaggttgcaggggggatctttgaatcacagccttcagatgccagaagggcagagggaatcccacacgggctggtggatcatgtgtgtgcatttctctcccttctagtctgaggaaactaagcatgaaagaacgtgagcacagagaagaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttaagagacagggtctttctctgtcgcccaggctggactgcagaggcacaatcatagctcacggcagccttgaactcctgggctcaagcgatcctcccacttcagcgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagtcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgctgtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgggactacaggcatgtgccaccacgcctgggtaatttttgtatttttagtagagacagggtttagtagagaccatggtgaaaccccgtctctattaaacaaatctctactaaccccatctctacaaaaaacagctgggcgtggtagtgcacacctgtaattctagctacttgggaggctgaggcacgagaatcatttgcatcttggaggcagagtttgcagtgagctgacatcgcaccactgcgctccagccgggatgacagagcaagaccctgtctcaaaaaaaagaaaaaggaacaaacaacagcaacgacaacaaaaaaacctctgtgtcaatcacagcctacaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgtgtgcacgcgtgtgtgtgtgtgtgtttaatatagagacagggtttcactctgttgcctaggctcgtttcaaactcctgggctccagtgatcctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgctcctggccaattttttaaggcaacgttttcagcccatggccagggtaaggcacagctagtaccaagatctggcttcactggccatgttatccaagaggcctctgcctgcctgcaaagtagtactgcacactgggatctccctggaccaaaccccagcttcagttttgggtacttcctcataagccttgactaccccagagtgtgagggattttgcagcctggtcccaggcatgcactcaccagtcaatggcatcgcggggctggccatggcctcccaagccacaaaagcaaccatatttcacataggcgatgggagttcagggaccaacacaacccacaattcctgccagttccaggatcccacgccggtgcacacataatatcctggaggctggggggtaaacaaaggtgacaggctgcaggtcagggcttcccagacccctgggaagggcatgagcctgagaggagcctaggtgttacagcctggctgtctgggtttgaatcctacttcctggctgtgtgaccttggacaaattcctaacctctctgggccttggtttcctcatctgtgaaatgggggataagctgacttcaactcatatgaatgaaatgagataatgagtataaagcccctggtgcatgaaaaggctattataatccggctgggctcagtggcttacacctgtaatcccaagattttgggaggcccaggcgggcagatcacctgaggtcagcagttcaagatcagcctggccaacatggtgaaaccccatctgtagtaaaaatacaaaaattagccgagcatagtggtgcacgcctgtaatcccagctactagggaggctgaggaaggagagtcacttgaacctgagaggcgaagattgcagtgagccaagattttgccactgcattccaacctgggcgacagagcaagagtctcaaaaaaagaaaaaaaaaaaaaggctaactattataatcaaggtcctcaaggtagccaaggagggaaaagagtcgtgcatgaaacctttgtccagttccctgtgttgggcactcggcatcatatgagcctacaggtgtctgtcaccaaggtgggctcctctgtggcagctcccaggccctggcactgccctgtgctcatgacttttcctccagactcaggctcagggcccttggtatctcctcttattttcactgccagataggaaggccccttggactgagcccagccatttatctagatcctggcacagcttggacatgtaatggtgcccaatgcatgtgactggaacccctgcattggacatgtaggaaacgaggccagccgggaaaggtaaccccacattcccacagccagcaggaactcaagcagaggcttcaacccaggcttctgacttgcaaaccagtgctccttcctccttacacagtaacaacaggggaaggtggccttccaggttgccagagccgagtggtaccagcaatagagtggaaactcacacacaggcttgcctgcttcctggtttaggtttagggtttatacggctccgggaggttgatgcattgtgtttgatcatccccttttttttttttttgagacagagtctcattcctgttgcccaggctggagcacagtggtgtcatcttgctcacaacagctccgggaggttgacgcattgtgtttgatcatcccttttttttttttttttttttttttgtttgagacagagtctcattcctgttgcccaggctggagcacagtggtgtcatcttgctcacagcaacttctgcctcccaggttcaagcaattgtccagcctcagtctcccgagtagctgggatcacaggcgtgccccaccacacccagctgatttttttatttctagtagaaacggggtttcaccatctaggctgggccggtctcaaactcctgacctcatgtgatccacctgctttggcctcccaaagtgctgggattataggcgtgagccactgcgctcatcctgatcatcttgtctctctttttttaaatagagacagggtctcactctgtcacccacactggagtgcagtggcacaatcatagctcactgcagcctccaaatcctgggctcaagcgatcctcctgcctcagcctccagatcctgggctcaagcgatcctcctgcctcagcctccagacatacgggcatgcaccaccatgcccagctaatttttaaatttttagtagatctgcggtctcactatgttgcccaggctggtcacaaactcctggcctcaagtgattctccttccttggcctcccaaggtgctgggattccaggcatgagccaccatgcccagtctcatttctgttttatctagaacatgttttcatcacactgacttttttgagaagtccaggccaattttaaattccattttgtctttttatcagtggaaaagtagcatatttatgttgcacgacaaagatgaatcaaataggaagaaaatgtaaaacacatttggggccgggcacagtggctcatgcctgtaatcccagcactttgggaggccaaggcgggtggatcacctgaagccaggagttccagaccagcctgaccaacacggagaaaccctgtttctactaaaaatataaaattagccacgcatggtggcacatgcctgtaatcccagctacttgggagggtgaggcaggagaatcgcttgaacccgggaggcagaggttgcagtgagccgagctcgtgctatcacactccagcctgggcaataagagtgaaactccgtctcaaaaaaaaaaaaaacacacgaaaataaaacggcatttagagttgaaagcttcaccttcctctctggatggtgagtcctcactctcccagcagcccacacctctgcctcaaacctccatggctcccatgagtctggttaaagctaaggagtctcactgcacctcaagtcctgggggtagtcagcccctctcacccctccctcatcctctcacacaagagtcatttactgtccctccagttatgcccggtcacgcagacactctgctgctcaaatgccctcaccccatcctcagcctgctcccaggccacctccctccagaatccaccctgcctgccaggtggtcatagggaccctcgccatactgtctgcttgtggcagtgccctccagcctggggggtcttccagagcagatctctggccaagcgcagtggctcatgactgtaatctcagcaccttcagaggccaaggcaggtggatcacctgaggtcaggagatcgagaccagccttgctcacatggtgaaaccccgtctctactaaaaatacaaaaattagccaggtgtggtggtggtgcatgcctgtagtcccagctactcaggaggctgaggcaggagaatctcttggacccgggaggtggaggttgcagtgagccaaaatggtgccactgcactccagcctgggcaacagtgagactctgtcttaaaaaaaaaaaagaaaaagaaaaagagcggagctctgatataagctgccctggcacacagtgagcttccagaaatggtcccttgacctctaaatccaccaagacccagggaacatgccctctctgagcactctgacaatgatttgcatttctctaatgaccagtgatgatgagcttttcttcacatgtttgttggccacataaatgtcttcttttgagaagtgtctgttcatatcctccggccacttttggatggggttgtttttttcttataaatatgtttaagttccttgtggattctggatattagcccgatggatagattgcaaaacttttctcccattctgtaagttgcctgttcactctgatgatagtttgttttgctgtgcagaagctctttagtttaattagatcccatttgtcaattttggcttttgttgccattgcttttggtgtttcagtcatgaagcctttgcccatgcctatgtcctgaatggtattgcctaggttttcttcttgggtttttatggttttaggtctaacatttaagactttaatcaatcttgagttaatttttgtatcaggtgtaaggaaggggcccagtttcagttttctgcatatggctagccagttttcccaacaccattttaaatagggaatcctttcccattcttgttttttattacaactttttacctaaacattcaataattttcactaactttttggcaatgaggcagctgagtctaagtaggttaaatcacttatctgaggtcacacggcaggacagtgcttgttctgcaaagttaagtgtgtttctttttgtggaccatgagaacatctccaactgccctttttgacttggccaccagggaactcagcgccatgttctcaaatccagtttagtaactggccttctggcctgtatatctttattctaccttccatcctgctctgttctgcttttacctcttattctagattatctttctttagtcctaattttaaatttatatctataatcttgttatatatatttcttggcatctactgtaagtgggtagtgaacgaataaacaaaatgtgatgaattttagaggactaagaggggcctaagtcacaccaagattcatgctggataatttgtcatcgacccagactgtggttctgcactcgccagtaaccagtttttttttttttttttttttgctttttgccaaccatacattttgctttcatggtatcgaagtggtttaagcttatggcttccagcctgcagtggctatgaggggtcagtctctcatcaggaggggttggcagactctgttctcagataggcagcaaggatggaggtggggcaggagcaatttcactacctgcctggcgtctgggtcttgcttagagaaataattccaggctctgctgctttcgactctgtctctcatggttccactgattcctgcagagatctagagagaaaatttccagcgaggagtttctggctcgtttgattttgaacacgttttgagtattccaccccttacccccccgcccccactcactactctgtagtttttttttttttaagaaaacagtttgaaagcacaaataaataaataattcaaaacagaggggccatttttatttactttggttgtttcaggagagggaagggagcttacactttttttgaactcttattctatgccagccgatgtgctgcattcttagcttaaaagcctgcttctctttgatttcagaataacttggaaataaatgatcagaccctgcatgctctgatcctggctgtctgctctaactaaatctcctcttccttgcttcctccagcgagttgttctcccttcacctcccagcacaagctttgcacgtgttgccgtctgtcctacaaaggtctgtcccttcccagtctccgtgtgactccctccttcacacccatggttctccactgaaatgtcctttgagcacgtctcagatgcctcagtctaaagtagatgattctgggctgggtgcagtggctcacgcctgtaatcccagcactttgggaggctgaggcaggcagatcacctgacatcaggagttcaagaccagcctggccaacatagtaaaaccccgtgtctactaaaaatacaaaaataagccaggcatggtggcgggtgcctgtaatcccagctacttgggaggctgaggcaggagaatcgcttgaacctgggaggtggaggttgcagtgagctgagatcacgccactgcactccagcctgggtgacagagcaaaactctgtctcaaaataaataaataaataaataaataaagtagatgattcacagaaacctctgttcttttagagcactcttcaacactttttatgctttttatgtttgatttctaataaatatgtttctttcactataccataagtatattccttcttctaagtttcattaaggtagaatcacgtatgtcttatttcctgttatatccctaagtacctagcatgtagtaggcattcaataaaaattgattgaatgattgaacactcaatcccatgatttgagtgttttttttgtttttgtttgtttgtttgttttgagacaaagtcttgctctatcacccaggctggagtgcagtggtactatcttggctcactgcaatctctgcatcctgggttcaagtgattttcttgcctcagcctctcaagaagctgagactaactacaggcatgtgccaccatgcccagtgatttgttttgcatgtgtgtgtatttttagcagagatggggtttcactgtgttggccatgctggtcttaaactcctgacctcaggccatccaccctccttggcctctgaaagtgttgggattacaggtgtgagccaccacgcctggccttttgtaattattctaacagctactacttattaggtgctgactatatgccaggcactgtgccaattgatttatttattttcagggattgggtcttgttctgtcaccatggctggagttcagtggcacaatcatagctcgctgaagcttcaaactcctggggtcaagcagtccccctgcttcagcttcccaagtagctgggattacagagatataccattacactcagctaattttaaaaaatggctaattttttttttcagagatggaaaaaaaacaaaaaacaaaaaacagctactacttattaggtgctgactgtatgccaggcactgtgctgatttttttttaatgttttttatttttttagagttggggtctagttctgtcaccatggctggagttcagtggcatgatcatagctcactacagctttgaactcctgggcttaagcaatcttcctgtctcagcttcccaagtagctgggattacaggcatgggctatcacacccagctaattaaaaagacattttattgtatagataggggtctggctgtgttgcccaggttagtctcaaactcctggcttcaagcgattctcctgcctccacctcccaatgtgctggtgttacaggtgtgagccatggcacctggccctgtgttgatgttttacatacagcatctcatttaatccccaccaggatcctgtggggatggattggattatcccccactccttggaagagcttaaggatacccaaccagttggtgattgagctgggatttgaactcaggcattctaatggcaaagctgtgccccttccactctaccatcgtgttcctctccaggggaggtgtccctgcagtgctgtgactttgtcgtcgaacatgtgctgaggtacgtgaatcctctggagaagaagggcaaaggaacaggctttccaggcaggaagcccctgcaggcgagggaggaaggctgcaagggacatggtaggaggtatcttgctccccatagctgggctgggaggatgagatggctgagagccaggagccgggctggggttaggctcatatcagcctgcagagggctttggggaacccaggctttggggccagacaaacatagcttctcacccacctgatcatttcctctctgttgtatcctatgtttctgggtctcagtttccttatctatgaaatggggataccatgacctgttctgcctgcttcatagagtgctaaggagcagatgacataacgtgtgcaaaagcagctgttcttatttctatcacttattttcattatcgctattctcaagcaggcagacggtaattttttacctctttcttttttttcacccttgagttgtttggaagttatttttaaaagtctttgaagtgtccttttccatatttggcaaaagcaaaatggaaattgatagcattgtcaccgtcggcatcccctcactccggccgcctggctgggggacagctctgggaaaatgtggagatgtctgttgtgggcgactggtttgttattgcgtgaacttttctggcgagacctgaccagctcccttttaaggcaattcctcgtgttcttgttcctcctcttttcttttcctgccaatgtcaggtcctttgtgccatctccaggctcagaaatccgtacagccagagtcggtccccagtttggccacttccagctgaaaagctttcccatgccttccctttaacttagaatagcatccaaatccttcattgtgaccaaggccctgtgcagtctgctcctgtcactttcctctccattactcagctccaaaagtgtcacctcccttgactcctccaatgccccacatggtttccagccccagggtctttgtggggtctttgccaggaatcctgttccccgtttttttgttatgggtagctctttctcatctttgacatctctgctccagagtcaacttcacacatggctcttccctaacccacactaaaaaataagcctccttaaagaaaaaaaagaggctggacgtggtggctcatgcctgtaattccagtgctttgggagactgaggtaggaggatcacttgagaccgggagtttgagatcagcctgggcaacacattgagaccccatctctacaaaaaaaaaaaaaaaaaaaaaaaaaatagcgaggcgtggtgctgtatacccatagttctagctactctggtggctgaggcaagaggattgcttgagcccaggagttcaaggctgcagtgagccgtgattgcaccactgaacaccagacgcagtgtcatgtacttgtagtcccggctgcttgggaggctgaggtgggaccatctcttaagcctgggagtttgaggctacagtgagccctgatcatccctgtgaatagccattgcactgcagcctgagttacacagatacgtctcttaaaaaataaatgaaaagaaaagccttttaaattcagtgtcttcgcatagttagtccaaccttaaggagtgttaccagatacaaacaggatgcccagttacatttttttttttttttttttttttgagacagagtctcactctatcccccaggctggagtgcagtggcatgatcttggctcactgcaacctctgcctcccaggttcaagtgatgctgatgcctcagcctcccgagtagctggaattacagacgtgcaccaccaggcctggctaatgtttgtatttttagtagagatgggtttttgccctgttggccaggttggtctcgaactcctgatctcaggtgatctgcccaccttggcctcccaaagtgctggggtgacaggcgtgagccaccatgcctggcaaaactttgtagcccagtttgttctatttttttttttttttttttgagacagagtctcgctctgtcgcccaggctgtagtgcagtggcatgatcttggctcactgcaatttctgcctcccgggttcaagtgatttccctgcctcagccttccaagtagctgggaatataagggcgtgccattgcacccaaatttgaaccttagataaacattgaataattttccagtattacatcagatacataacttgtatttaaaaaatcattccttatttcactggatttaaaattgaattgggtgtcgtatatttttacttgttaagtctggcaaccctaccctctagagagaggtgttgaatgaatgagtgtgaagtccttagcttagggcctggcactcagtaggtgctaagtaaatgtcacctgtcagcatcttcctcctcctcttcttcctcctctagttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagtgagttatcacagagcgttccctccagcactgggtcatgcaaatatttattgcgagcgttaaataataaatggagcagcctgcccaatggtaaatctgtcatgtttggtttcagccaggagttgtgatggctctggaatcgctgcccgtttcaccgcatccacctgccctctagaggagcaaggcaaacagccgagttctctggggtggcatcagtgggctggtgtggaagccagaggggcggtggggggagtcagccaggcatggaaactggcaggtaaggcagccctgtggcccaggaacctgagccgcagccacaccgagcaggcctggacctttgagtcccgctgccaccacagttctcaggggacacggtctcattgtccacatctggatttatctttccgtatttccctcattgctcttgtcagcttcactctggctgactggctggagctggcaagcttctgaaagtggagtcaaccttccgaccctttttctaggctgagtggtgggtggaggaatgagaccgtgtgttggactcaaactcgatgcaataacgtttcccagcccctgtggtgtgctggggctcctagcacacatcctcttgtttaacctcagcattgcaacctgaaacacagacacatgggttcttgagccagatgcctctgagttggaatcctatctctgcacttaacaagcggtatgaccttgagtgagccacagtttttcagagcccctgtttcctgatctgtaaggtgggggagatggtggcactcaccttatggggctgttatgtattagtccattgaggtgtcttagcctgttttgcgttgccataaaggaatacttgagggtgagtaatttataagaaaagaggtttgtttagctcacgttctgcagactgtacaagaagcatgatgccagcatctgcttctggtgagacctcaggaagcttttcttcactgtggaggatgaaaggggagcaggtgtgtcacatggtgagaagaggggtgagagagagacaggaagggtgccaaacacttttttaacaatcagacctcgccgtgaactaaaagagtgagaactcactcattactcagggagggcaccaagctattcatgagggatctgctcccaccacccaaatacctctcgccaagccccgcctccaacattggggatcacatttcaacatgaggtttggaggggacacacatccaaactatcttatgaggtagtaggataatgtaggtgaagacttgcacagtgcccgggacctggggacaaatgctagctctaatggttaataatggtccagagaagaaaataactgctcagatgcacagacatgactgcactagtcaaccatgcaggtatgagtccccatcctagagtatggggtgcatagagctctagcccaccattattgagttgtagaactaaggctccaatctggggctttatggatccctaaatcatgccctttcaccttccccatatctgctttattcctcatagggtggcagggagggtggagctcatgcctggccttaatcatcatggcctaagtttggtagtgtccaaacagtggtgaggggtgaagttgtagggttgccaggtaggttgtgtttggcttcaaatcactgagaacccaactggaagtggtgtagatgctaatggaagttattgtttctctgcagggggccatgtggttaattgattcagtggctccattgtggaatggtgggccttgtttccttccacttttccactattccattcttagcagctggctcttgccctcagccacaccccatcatggtctcaagataatatggacaagagagaagagagccttcttccacttgttccccgcttgtttttgagacagggtctcgctctgtcacccagactggagtgtagtggtgcaatcatagctcgctgcagccttgaacttctaggctcaagtgatcctccttcagtttcctgagtagctgggactataggtgcatgctaccatacccagctaacttcagagttttttctagagatgaggtctccctctgttgcccaggctggtctcgaactctgggcctcaagtgatcctcttgcctcaacctcccaaagcactagggttacagatgtgagccaccacgcccagcccatctgtccctttttatgatcattttctcattttctcagaagctgccagctgacttctccttcatcgcattggtcagaaatgtatcacgtgcccttttctaagccagttgctggcaagggaatggaattcccaaggttgccttagaccagtgcttcttaaagtgagatccccaggccagcagcatctgccatgtctaggcaattttaagaactgcaaattctcagaccccagttcagacctactaaatcagaaactctgggggtgggatctatgtttttatttatttatttactagaatcggggtctctgttgcccaggcaggagtacagtgacactatcatagcgcattgcagcctccaactcctgggctcgagcgatcctcctgcctcagcctcccatgtagccaggactagaggtgtgcacccccacacccagctaatttttttattttttgtagagacagggtcttgctatgttgtccagtctggtctcaaactcttggcttaaacaatgctctggtctcaaactctcagcctcccaaagtgttagaattacaggcgtgagccactgcgcccggcccatagtctatgtttaaacgtgccctccgggggtttctgatggacactgagtttgagaacctctggtttcctaagatcttttcctctgaagagccagagaataaatatttcaggcttgtggccacacagtttctgtagcaaccactctgttctgctgttgcagtgtgaaagcagctatagatgataataaataagtgaatgggtttatttatggagactgagatttgaatttcacctaatttttatgtgttaggagatattattacacttttgatcttttctaactacttaaaaatgtaaaagccatttccagctcctgagccgtacaaaagcaggtggtgggccgggtttaggcaatggtttgccagccctccatcagactgctcaagattcatcccctgaaactggggagagtctaatagtcttaaaacacagagagccccagattctttagaaaattggaatttgggctgggtgtggtggctcacatctgtaatcccagcactttgggaggctgaggtgggaggatggcttgagcccaggaatttgaggccagcctgggcaacataatgagaccccatctttacaaaaaataaaaataatagtcggacgtggtggcatgtacctgtagtcccagctactcaggaggctgaggcaggaggatctcttgagcccaggagtttgaggctgcagtgagctatgatcacgccactgattgcagcctgggtgacagagcaagacactgtctctgtctaaaaaaaaaaaatgaaatttgggccaggcgcggtggctcatgtctctaatcccagcactttgggaggccaaagtgggtggatcacctgaagtcaggagttcaagaccagcctggccaacatggtgaaaccccatctctactaaaaatgcaaaaattagctgggcgtggtgacacgtgcctgtactcccagctactcgagaggctgaggcaggagaattgcttgaacctgggaggtggaggttgcagtgagccaagattgcaccattgcactccagcctgggtgacagagcgagaccctgtttcaaaaaaaaaaaaaaaacaaaaagggctgggcgtggtggctcacgcctgtaatcccagcgctttgggaggccgaggcgggcggatcacaaggtcaggagtttgagaccagcctggccaatatggtgaaaccctgtctctactaaaaatacaaaaattagccgggcgtggtggcaggcgcctgtactcccagctacttgggatgctgaggcaggagaattgcttgaacctgggaggcggaggttgcagtgagccgagagtgcaccactgtactccagcctgagtgacagagcgagactccgtcaaaaaaaaaaaaatactgataatgacagtgctaacagcaataatagatagctaacaagtgtggagtgcttatccatcttctagtccccaccttcctttagcccaggagttcgaggctgcagtgagctatgattgtggcactgtactctagcctgggcaacagagcaaggtcctgtctctaaaaaaataaaagcataaaaataaaataaccaaactttttattaaccttctacccccagagggccccctccctcaaatagctcattaactagacctggtttgcatgcccaccccctctagggactgagcccaacttctgagatagggacccttgaaagaactggggttctgttagcaagaagaattaagacaagaggatgacttttggtgttgacagtgtctgcccctgttttttgtttgtttttttgagatggtgtctcgctctgtcacccaggctggagtgcagtggcgtgatctcagctcactgcaacctctgcctcctgagttcaagcgattctcctgcctcagcctcccgggtagctgggattacaggcgtgtggcaccacacctggctgatttttgtatttttagtagagacaggatttcaccatgttggccaggctggtctcgaactcctgacctcaggtgatccacccgccttggcctcctaaagtgctgggattacacgtgtgagccaccgtgcccagcctgccacagttctttacacatttgatctttagctcacccaacaaccttgtaaaaatatgattgctacccataattttcaaataatctacgtatgcgtaagagagagaagtgattccccaaagatcacgcagctaataaagtggaagggagaacccaggcccacctggctccgaagctcacactctttccactaagctgcctgcttctttcattggaatagaggttctcaatcgtgaatggtaggagtggggtgcggtgaattttgaccctcgggtgaaatttgaaaatgcttggagacatttttggttgtcataattgggagaaagggtgtgatattggaatctagtggatagaggccatggatgctgctaaagtttttatagtgggccgggcgtggtggctcatgcccataatcccaatattttgggaggccgaggtgggtggatcacctgaggtcaggagttcgagacgaccctggccaacacggtgaaaccgcgtttctactaaaaatacaaaaattagccaggcgtggtggttggtgcctgtaatctcagctacccgggaggctgaggcaggagaatcacttgaacccaggagacagaggttgcagtgagctgagatagcgccactgcactccagcctgggcgacagagcgagactctgtctcaaaaaaaaaaaaaattatagtacataggacagccccacaacaaagaattattcagcccacaatggtgccaaagttgagaaaccctatatactaaaacaagctctttgagggcagggatcatactaccttgactaccttgttcaattctcaatcctttataccctgcctgtcctggcacattgtaagtgctcagtaagtaatgactgagcaactgagcagatgtgctacaccagattccagagtcaaataatcatagacttggagaagtgcagggttatgggggctgcagtataacactctacctcacagtgggtgcatccaagccaccagcttcccctggttccagaaggcctgttagagacatgtcttgcatttgcacttggtccagcacagcccatgcctcccacttgtgaaaagaggctgactgatgggtggtgatcagggttggctgccttttcatttttgagatcatgggaacagagggaccggatgaagaaacacttctctgaatctacccatttctaaatggatgaatcaccaaggaggaaactcaaagattaatttctcactgcccttcttcccttgctctgctctttgtagacagttactggtgctccagggcaaaagataatgaaagttcttccttgcatcaaactattttcttcaggagatagagccagcattagccaaagagatggtctgggctctgggagcttggcttggaggcccaggacattcaaacagtccttcccggagaacaggctggacctgcagtgatgaataattattttgcaattgacagttcaatacccaccagattcttcattgtatgtttctgtatcgtgtcaagttatgagaaaacgcaatattctttaacagctaggcaagaacaatggtttttgctcatttgtttgtttgtttccaccccgcagaggtcagtttttgcagtaagaagagtctcattctttttttattttattttatttgtattttgagacagtctctctctgtcatccaggctggctggactgcagcggctgcaacctccatctctcaggttcaagggattgtcctgcctcaaacttctgagtagctgggactacaggcatgcctacgccctgctaatttattgtatttttagtagagacaaggtttcaacatgttgtccaggctggtcttgagctcctgacctcaagtgatccacccgcctcaccctcccaaagtgctgggattactgccatgggccactgtgctcgtgactcttcaagaagagtcttgaatttactctgaatgtgtccttggttggcacaaccacgagcagaatatgcatcctatctatcctcacaaacactgcgtttattatccccaatttgcctttgaggaaatggaggctcagagaggttaaataacttgctcaaggtcacgtgggcaatgagtggtggagtggagatttgaactcaggactgtctgtgaccctcccagccctgcagtctccaagtctccagtactatctggctctaaaatccgtactattccctctgctatgtttttgtggcgacttgaactcttccttcaaagtcttggctgctgctatgaactgaacgtgtaccttgtgaagttgtattttttccatattgtaattccatccttcaaaagtaagtcttgttactgaaagactgtttcaaccgtcctggggtaggagtggctaacaggttggcttgggtcccacagtgaaatctgttctgagccagaccctcccgaggggacaggggacgagcaggagagattgtagctgaagtagacatctcctgggttcccagaaatgtggaagaaccttgtgcaaaaacagcttcctgcagagctgcaagatgggatccaggttattggtatttgagcactgtgtttaggggctatgagagaaacctaacatgaaccggctgaaggaaaaaagtggaggattacatgaaaatgaattcagggagcttgcaggtgtactgaagggaagtgtgagctctaaaagctggaaaaggtctaaacgtgtagattacaaaaatatctgcagcttagcatggcaatgacggataaagcgtcagatatgtgtttgtcatccagttgtctatggctgtgcaacaaaccacccaacatgtagtagcttaaaacatgacagtcatttattttgctcacacatccacaatttgggcaggatgttgaggggacagttcgttcctgctccacgtggcatcagctggagctcaccagggggctgcagaattcatttctgagatggctcctctagcggttgctaagttggcgctttctggttggctgggagctcagctaggctgtggtccaggggacttggttcctttgtttgggcctctcctctcttcagctacttgggcttcctcatcgtatggtggctgggctctaagacaaggagaacccagtggaagctctgtcacattttatgatgtagccttggatgtcgcataacgtttcttctatattctattggtcaagcaatcgcacagtctggattcaacggtagatgacataggttctaccttttgatgaatcaaaaaattctgggatcatggtttgaaactaccaaaaagtagcggctgtattgtttgttattattacaaagtaggccgtgtgcagtggctcacacctgtaatcctagcactttgggaggccagcctgggcaacataatgagacccggtctctaaaaaaaaaaaaaaaaaaaaaaaggagagagattagccaagtgtggtggtgtgtgcctgtagtcccagctacttgggaggctgaggtgggaggatcacttaagcccaggagatcgaggtggcagtgaactatgatcacactaggctgggagacagagtgagaccttatctcaaaaaaaagttaatgataattactacaaagcaaggccaatagtacaaaaacagtgatctttcacagtctatgatatagcaggacagtgctagatgttccccatctgctatgccatttattcctccccaaaatttgggaagctcagggaggcatataaactgcctaaacagggccgtgaagctaggaagtgctaaagccaggatttaaacccagaagtcaaatgctaaagactctgctagactgactacctgattctagaggctggggtgtgtgctaggtatctgaaagattggagagatgcagacagaaatgtgtgaatgtgagtgtgcaaatttgcacaaggccagtagcacctaagggggcccatgtgggagatgggagggtccctgccatctgcttccttctcctcatccatttcaccctggtcttctcagccctcccctctcctccatgcccctccttggtctcttcccatggaccctgtgagagcccctctccagctgtttatgggagatgttgaaggagaagcaagggctcctcacgaccctgtctctgcctctttcctgtgctctgggacatctgaactgtcacatagtcagctggcagggaagcccaattttcctttggctctccaaagggcctgattcatgggttaggctgagatcagatagagcccttgggtcaggtgggtgggattctggctcccagggctgctggcaggtgccatctggttgttctggagggagttgaggggaatggttcccacctggacagtgtctgaggggtgagctggtgaagcactgggcgggtggggagctggcagggacgggacagatacagagagtgccaggaggtgtggacagctgctcgcagggctcttggtgactttgccaggaaactgtgtctagacagcctctgtctgatctctcttctcatcccacatcatctccccggttcctccctggcctgaggccgtcctgccaggttggtgcagggatatgttgaacaaagttcagatgtgctgtgtgcacagtaccaggctcagcatagtctgagaatgaaaagcagcttctgaaactcagccctgcctcaggtgcagggagctgctggtcttgccaggaggcttaatgcctggatcaaatatgagggggctggctgggcatgatggctcacactcgtgatcccagcactttgggaggctgaggtggtgggaggattgcttggggtcaggagttcgagatcagcctgggcaacatggtgagactctgtctctacaaaaaaactaaaataaaaaaatagtcggatgtggtagtgcacatctgtggtcctagctactggggaggctgagataggaggatcacttgagcccaggagttcaaagctgcagtgagctgtgattgtgccattgcactccagcctgaatgacagaggcagaacttgcctccaaaaaaaaaaaaaaaaaaaaaaagacaaatatttgggggcttccccagatagacgtctggtgctatggtctgaatgtcattgttccccttgaattcatatgttggaacttaatacccaatgtgatagtagtaagaggggccccttaggaagtgactaattcatgaggaatccaccttcatgaatgggattagtgcccccttttataaaaggggcttgagcaagcgcctttgcctcttttgccatataaggacacggcaacaaggtaccacctatgatgcagagtgagccctcctcaccaggcactgaatctgcaggtgccttgatctgggacatcccagcctccagaactgtgagcaacacacttctgtcatttataaattacccagtctaaggtattttgtgataatagccccaaaatatgacacccagagagtgtgggccctctagaggtcatttcttccaggcccctgccagatgctgagctcagcctgcaaccccaggctgttgaaaatccgaggaggctgaggtcagggagggaggcaggaggccagcaggccatcagggaagggaccccagtgggctcttgaggaatggggaaggggcattaaagggcccaggtagaggcctggagtggtggtggtggccgtgggggtgtgagaagctggtttgggtgaagatgcagggagacaaacagagacccattgggcacggacaggtgctcacatgtttccttgcacctggcatgcttcccctggtgaacactgccaatgtccacccacctgttcttcacccaggtgggcctcgggtctgcagggacacagcaaaggaatgaaagccaggggcaggggtttaaatcctggctctgtctcttttcctccgtgtgacctggggcaaggaaatggtctttatagctcatgcggtctttatgcagttgtcttaggtgatgggggatgagaaagtgccttgtaatcaataaagacagatttattacgataatacaaatttattgatttgtaatcagtaaaggcagattaaccataccatttttttttttttaaatagggtcttgctgcgtctcccaggctggagtgtagtgtcatgatcgtagctcactgcagcctcgaactcctggctcagactatccttccacctcagtctcccgagtagctggagctacaggcgcacaccatcatgctcagctaatttttatttttatagagatggggatctcactatgttgcccaggctggtcttgaactcctggcctccagcaatcctcccatcccagcctcgcaaagtgctgggtttacaggcgtgagccactgcacccagacaggatcaaccgtatcttttgagcatccgttctgtgcctggcaccaggaccagttgctgtgggtcaacagaacagtttcaggtgggtggtggatggaatggctggtgggctcagagctagagcttaggcccctcagctactcctctgggcaggagtgagcagtgctcaccctaccccaggcttaggccacttgcgatgtggggttcctcttcgcgcacatctactgaccctggaactattgaagctattttgtgagtgctgtgccctctctgctgagacacaatccctgtctggcacacccccaacacatcatttgcccctggagtttaactgtactttggtgaagagtggcagaggccagagggaccccaggggtggacatgtgattagcttgatgggcaaccccaggacagagaacagggatggggaaggagatgcttcccactgaagaccccatgcactctgcagcttacaatgctcctaaaaccccgatgctggtttataaactctcttgtccaattgctggggttcaactgggagccttggtgtgtcccgcccctcccccaggctgtcccgttgtcaggcgagaatgaggcttatttctgctcatccaccaagcttgtctgtttccaactgtccattttttttccatccatctatctgcccgtccatccatctttccatcacctcctgtccttaggcttaggggatttcctcttgggaggggaactctttttgcagaaaaggacgctgagccccaaaagctgagtatttcccagcataaatgtctgagccctgttccctgggcaggtcctgtattggggattcagagttgaattggagttgtctcagcctgtgaaggaaagagacctgtcaacagggggtgacaaggagagtttgtagccaggtgtggtggtgcacacctgtagttctagctaattgggaagctgagcagggaggaatgcttgagcccaggagtttgagaccagcctgggcaacatagtgagatggccccatttctacaaacattgtgaaaactagccacgcatggtgacagatgcctgtagtttgagctaatcggtagtctgaggcaggaggatctttggagcctaggggttcgaggctgcagtgagctaggattgtgccactgccttacagcctgggagacagagttgcaagactcccagttgcgatcatttaaaaactgggagactgacatagcatctggcttttagcttctcttaatttattagaagctctgacagcattgggcccatgttcccacgtggagacagttggtggatacaagataggcagctacctccgtctttcaatggggcatgcactccaattcaccacagaccccaccattccctactgcttctcattcctccctttcttcacttatgttatctgcctggactctctacaaggattttcatttgtggttcctgtttcaggaacaggccatggtgtggcctttcctgaccttgtcaagcctcaggttcccagaggggaccaaaatagatactgcacattgtagagggatcagctgaggtaatataggtgaaagctctcaggaagcctaaagctctctgcaatcacaaagctacacaaatagaaattattatcatcattatttataaccattgaaaggacaggagacaaagaagtcagtccccaccatacccctcccaaccccaagcccacaagggtatttgtgccattatgatggcattgatcattgacattgacagttattattaaacgatgtcaacttccaaatgcaaaatgtttaccagatgaactcaaatgggctggcagaaataatgtccaggtgccatctaccttcaactcctcttctcatgaatttctgtggcatttctccagggcccagagtcaataagggagagagaaatgactcctctggtttactgaaggtgtgacttgtgattccagccaatgtcctgttggtcccattgtctcccctgccactacccatgtggagtcttagatcttggagactgtactatgtgggccaactctctcctcaagacacatttattaaaaggtgggtgaagtatcttctcctttgcctgtgtcttttgcccaaagggaagttgattgatgacaatgctcctttttcaagctctgattgccggtggaggttggataaagcatcttgctgtgatctctaagtgggctgtgccttgaaaacatgattgttgtgtctaatcatgtgtgtctgtggctcccttgccactcctggttgccgtgtcactgtgactctatttaacatactttcaggacccactgtatctgtcccgcctctctctggatcttcccaactctgtggttgcctccctgctatattcatggcccctaggggatgccacgtgtgttcggttcttcatgctgttcctctgtctaaaatgttctcttctgtggcagcttcctgcaaacatcttcttctctttccagactttctttgatgattaagaagcttgcacgacctaagtcttataattctgaaaatcatctcctagtttccaggaccccagatgcaccagcatggcttagggaaaggaaaatgacctttggagagagaatctttggagggatttgagcctcggcattgccacttactagctacaccatttgggacatgttacaagcccccctgaacctcagtttcctcatctgtgaaatgggcataatgataggccctaaatcttgtggtgaggcttacatgtgccaatggatataaagtatacatcatcacaatgcctggcacatgatgaaagattaataggggcaattaatatagtgtttgtgatagacccaaagatagactgacccgaggccgaccctgggcaccttttcaactgaaatcccaccaccttatattttgacttctaggtttcctttccctaaaagagaagtttggagaaggatctagaattgttggttaatcaagggcttgctaccttctaatcacttcatgttgatactaggataaagagcaaacatccttcatggggtttacaaggccctccatggccaggaccgtgtttatgtccccagcctcatagtccacttctcctctctccctgggtggtgacacattacacagtaccctcgcacatgctcttttgcccacttaatgcctgctcattcttcaaagcccaggcacttcctctggaagccttccgcagctccctgtgttccttctcgacagagtgtaaccgcccattgggtccaccttgcccgctgcctagacagagctgatttatcaagacagggggattggaatacagagagagtaattcatgcagaggggcattgtgggagactggagtttgattatcactcaaatcagtctccacaagcatttggggagcagagtttttaagaacagcctggtaggggtggttagttgaagccagtgagccaggagtgcagattggtcagggaagaaatcatagggagtcgaagctgtcctcttgcgctgagtcagttcctgggttggggccacaagatcagatgagccagttgatcgatctgggtggtgccacctgacccgtcacgtgcagggtctgcaaattatctcaagcactgatcttaggaacagtttagggagggtcagaatcttgtaacctccagccgcctgactcctaaaccatagtttctaatcttgtggctgattttagtcctaacaaaggcaatctagtccccaggcaagaaggaggtctgctttgggaaagggctgttatcatctttgctttaaactacaaactatgaaccatgaactcagtttctcccaaagttaggtcagcctacacccaagaatgaataaggacagcttggaggttagaagcaagatggaattgatcaagttaaatctctttcactgtctcagtcataattttgctaaggcagtttcaagagcacttactctagtttctggttttacattcatgactgtgttttatttggttcatgtctaattcctccactggaccgagagctccatgatggcaggaaccaagtccgtgggtggccccctgtggtgtccccagcattgaacacagcagcacgtccctcatgggtgttcactacataataatttgttggatgcacaggtggatacatgacttactactttaagaatgtgtgcatttgagatgtttacttggaacaacgaaggcttattcttgaagaaacaacaagtgataagtcaccagaagacagaaaacagcatgttggagctgggtggctcctggtgcctgggaaatgaacccttggggtggttcttggaaggaagtgagcaggtttagtcccatctgatgaactctttcctctccatggttaagttggcttctaactcagggactaagttttatttgagactgaggccactgctggtgggttggttggtctcctccacctttcccttcacccgtaaatgggatattagtgaacgggtggcataacccacctgagggttcttatagggtttcaggagaacagccctcatctcccaatttcctgaactgccatcaagataactgtgtgtgtgtgtgtgtgtttgtgtgtttaatcgagacagagtctcgctctgttgctcaggctggagtgcagtggcatgatcttggctcactgcaacctccgccactcaggttcaaacaattctcatgtctcagcctcctgagtagctgggattacaggcacgtgccaccacacctagctaatttttttttttaagatagactgatttttgtatttttaatagagatggggtttcaccatgttggccaggctggtctggaactcctgacctcaggtgatctgctcaccttggcatcccaaagttctgggattacaagtgtgagccaccacacctggctatcatcaagataactctttaaataagccaaacatttattggccaaaagcaatgcacatgtgctgtcaacaagcaaatttggggaaacacaaagagaatagaaacagaaaataaatattaaccacccagatgtaatcatattagcattttggggcatatgtttctgattctttttaaaaaatatttatgtctctctgtgttttctatttatatatgtattgcaacctgatttttttcattgagcaaatgtaaaatgaacagaaaatgtccaggaaagcaaatgtctcccttctgctggcctggtgtattacacagggttctgtggagggacagaactaataggatagatgtatatacaaaggggagtttattaaggggtactgactcacacggtcacaaggtgaagtcccacaataggccatctgcaagctgaggagcaaggaaaccagtctgagtcccaaaacctcaaaagtagggaagccagcagtgcagccttcattctgtggccaaaggcttgagagcccctggcaaaccactggtgtaagtccaagagtccaaaagctgaagaacttggagtccaatgttccagggcaggaagcatccagcacaggagaaagatgaaggccggaagactcagtaagtctgttctttccaacttctgcctgctttattctagccacgctggcagctgattagatggtacccacccagattgagggtgggtctgcctctcccagtccactgactcaagtgtaaatctcctttagcaacatcctcacagacgcacccaggatcaatactttgcctccttcgatccaatcaagttgacactcaatattaaccatcacacctggtatgacagtactagccttgtcccaagaggcaggagccccagaactgcagagcatctgatagagatgtgaatagtggctttggaaggaatgactgtggccaggtaaggtgacaggtaatggcgaaaacaggcatgaaatcgtggggcagttcaggtgagccattccccaatattcaccaagagataatagggaagggagagagagtaggggtctcaaaagcagggtcacggtgctgataatctgaaaggtagggtctcagagccattgaatgtttcatttattcactcaacgagaatttcttgagtggctaatatgtgccaggtgctgcagcagccagtggggattgtaggtcacaaaaacatgacttcattcaaagcatgcaccattatttacatatgtaaagtgccttggcatgaaatagaagcccaataatctcttgcaaccatagagatgagcattaatgacttttccagaattgcatctatggttggtgattattcctatgtggccaaatgaccagaaggagcagaaagctacatttttgtggcatcttgtatacatagaaatgattgctgtaaatatatgttgactccctttaatacatatgcaactaattgaaagcgggcagtttatggtgtagtatcagtgaaacgtgctctgttgccattaagtatagctttgttacattattgagacaacttgccttgggggcactggggtaagttattgcttcttcaaccatattttggtccttagaggaccaaccgctagtccagcttttattacctgctgtttctttaatcacaacagggaaatgttggctaggcatcggacgggagacttttcttataagatgaaatgagccaagattggaagacgacatttttatttgccttacaaatggactggatacagtgtgaatggcttcgtgaatgagatgaagggctctgctgcgcagcaatcccaaaccattcacccttatgcagaggcagagagcctcctaaatgaattgggttctgttggagttagctgctcttattttcctgtgctgaggagtctggagtgggagggtatccatttcccaaccaataataattagctttgattccaggcaacatgtgcatttttaatccgttaggcatagggtcttcccgggacctatacgtttttcaagatctacagaaatgtttgagaccaaaaacaaacaaacaaacaaacaaacaaaaaacaccacacaaacacacatacacacacacacattggcttaaaaatgcaaaagagaaaatgacaaaattgaaattaatgaatatcttaaaaattacctacgctgggcatggtggctcacgactgtaatcccagcactttgggaggctgaggcaggcagatcacctgaggtcaggagttcgagaccaggctgaccaacatggtgaaaccctgtctctactaaaaatatgaaaatgagcttggtatggtggtgcatgcctgtaaacctgtaatcccagctactcaggaggctgagacaggagaattgcttgaacctgggaggtggaggtggcagtgagccgagatcatgccattgcactccagcctgggcaacaagagtgaaactccttctaaaaaaaaaaaaaaaattacctacaaattgtgctgctttgtcaatatcactaattgttaaatttaacattcctagggatttcattacatctgaaaaatgtggatagttagaatttcccactttctagacctcctgaatatgcacaattaccaagaaatcacatccaatctaaatttaaataaatcacctattgccagataatttcaggagcagaattttaaaattttctcaaaaaatgtttagagccaaaaatccatttaatgtaggatacaggcaaatttgtagcatgtttcaaatgctttctggtgagacctccaaaagtgaatgtgtctagggtatataaaattcttaaaggggctttgtcatccttcttccccactcacccataaaatagatgagataaaagctatttctaagggtggctcttttgtgaagtatttgagctttacggtagatgagactattgtttagtaaatatttgttccctctcctattacatcattgatgttcagctaggctatgtgacttccttttccctgagagatggcatagtgtacttccctacccttcgactgttgagttgagcttaactttctttggctaatgggatgtgagaggacataacccttatgaaaggcttgaaatgctctcgtgtgatgagtttgccttcttgtgcttttgccttctctatgagaaaaacatgacttagttggttgctggtcctagaaaaatgagatgcatctagagcagagccgccccagcatgtcttcagacctgcaacctccagcagagctgctccagccaagctatacgggcatggcagagaaataagctctttctgggatttggggttgtttgtcttacagcatctagctgactgctgcaagttcctgcacacagtggtgcttactcatgtttctgaaggaatagcagtttgtttatttcaaccatattgctagttatttgttattttccaccatattgctagggttataactctgaaaacaagttcagctacttctcacatgttccttctgcctgaaaactttgtctccttgctcttcacgtggatggctttctatctttggctctggatttaaatattactcccttgggatgacctcttctgatacattatttaaataccatctgtggtggagcctactatttacatattgaaacatctacattcccttttcttctctgaaataacaccttattttcgggggaaaaatttcaaactgagacaatagttggaagaacagtacaattaagttttccctctcctcgaatcgtttcccaatactttactgtgtgtgtcttgcaataaggaccttctcctatatgcccataatacgaccattaaagtcaggaaattattataacattgatacattaccaccatctaatccaaaggccccattcaggtttcactgaccatcccaataatgtcctttataatcttgcagggcaagattatcatagcatttaattgtcacgtcttattccggcagattcatcagtctctttgttactttcttgaccttgatacttttgaagatacaggccatttatgttgtataagagctctcaattggggattgtctgatgctttttcgtgactagaactaggtcgtgcaccaattctaggcttcaacaccccatgccagatctctgtcctatcccctctcgttgatgcttactttggttggtgccctttagtgactttaacactgaatatttgaggaagaataaaagatgaaacactgattttaattagggtgacatagactctgctttaaacaacaacaacaaaaccaaaaccctctaatttcccaatctctcatgaagctacccaagccatgtgatttagctttggccaaggaatgcaaagagaagagtaatatggacattttctcagaatgaggaccatatatttctttgcccatttttcctgttgttggtcttgaattaggatgcaatggctagatctctggatgccatatttgaccatgaagtcaagtccaaatgagaaacgatcattcccaaattaaggccgtgacttaaggaggtatataaaagagaaggtggcaattggttgaatgtagggtgtgatggagaaggactcaaagatgttgttcaggctcttggtttgggtaactgggtgaatggtgatgatattcatggagaaagtgagctaaaaattaggagtaaaattatttggaaggcaagttaaattcgtttttggaaagaaatgaatctgagatatacaatggacatctgacggtgttctctaaggtaacgggaattggaaacagatttcaatattgaggtggtagaagaaggggtcaaatcatcaaatcatgattctgttacttggaaggaaggctgaaggggagaccttgagcatcttgtttcttcttagttccatttatgctttatgcttttgagcactaatcacaacagatactgtggaggctgagctccagccattgtcaagcctgtgctccagcactggtataaattactggagtcctcattctagaggaaagcacggggacgaatcttttctagggctctttaccttgtctactcttcctgcagggagtagttcagactttcttcttctacctcctcttcttctttttttctttatagagacaagatctcagtctgtcacccatactggagtgtagtggcacaattataactcactgcagcctcaagttcctgagctcaggtgatcctcctgccttagccttctgagtagcttggactgcagggttcatgccaccatgcctggcttatttatttatttatttagtagaaacagggtctcactatgttgcctagtctggtctagaacttctgtcctcaattcatcctcctgcctcagcctcccaaagtgctgggattacaggtgtgagccactacacccagcctaggtttttctttcttttcaatgaatcataacccttctctcttcatttctagtgaacatgcatcaccttatcctatcacaaaccaactctgtgacaaatgtactattactatgcccattttacaaatggaaaaactgagacttaaagaatttaaattggctgggcgcagtgactcacacctataatcccagctcttttggaggccaagatgggaggattgcttgaggtcaggagttcgagacaagctgaggcaagaaagcaagaccctgtctccacaaaaattaaataaattagccaggtgcggtggtgcacacctgtagtcccagctactccacaggctgaggcaggaggatagcttaagcccaggagttcaaggctgcagtgaactatgatcatgcccattgcactccagcctgggcaacagagcaagaccctgtttctaaaaattagacaaaataccaagcaacaacaccaacaaaacaacaacaccataaaacaaagttaagtatcctggggttatactggaatccaaataatctggtttaagagcttaacctcctaaccaccatgctatactgccttgtggcaactcatgccttgtgaatctttactcctggtagtgtttcacagttgacagagagcttttgcattcttgatctcatttggtcctcacaacagccctgtggggcaggtaggaaagaccttgttattagacatgagggtcctaagaaccagaaagctaatggacatgccgaaggtggcccagccaatgaatagcagagttagataagaattgtgatcttcaggccgggcacggtggctcacacctataatcccagcactttgggaggccaaggcgggtggatcacttgatgtcaggagttcaagacctgacctcaagtctggccaacatgatgaaattctgtttctactaaaaaatacaaaaattagccaggtgtggtggcgcacacctgttatcccagcttcttgggaggctgaggtaggagaatcgtttgaacctgggaggcggaggttgcagtaagccgagattgcaccactgcactccagcctgggacacagagccagactgtctcaaaaaaaaaaaaattgtgatcttcagcagccttatagagcacttcttctactgtataatcctcgctttcctcatttacatctgtgaaaaagatattccttttgttcagatgctcttaggtgctctgaagcaagcaatagcccaagctggcattttgagagccatttcatggatggaaagcggaggctcaatggctaagggaattagccttggttctccagtgtgtctgcagtcttcatggcattggtgctgctgatccacagtcatgccagaggttgggtccgcagtgaaccgcttcacagctggatggttgggggaaaagagaggtctaatgatagaaaccttccccaaagcaaaggatgtaagcccacaccgagaattattagaaagaataatattctcccacactgagaattattagaaagaaagaaagaaaaactagaaagaaggacaaaggcattccagcatgcttcctgtgacagattgagccagtctttgtaacctcagattcacaaggacattgcaaagaatttcctgttgcgctcaccaaaattggctggcccttgtgccagagtcccactgacatccagaaaactattgcccatcttctctgggctgtgcaaggattagtgtcataatagatcatcacagccaaatgttattatgcaaagcagaaagctgcaagaaatggatcttcattcattgaatttgcatgtttggtggggactgcttcagacttcctttatctcgtgatcagtcgtgtgtgttgatcctctttgcaagttgttgtgagaactgggtgcagcaaaagctgccacttcaagagaccaaagggatttctgagatgaaaaagtgcatcaatttgcataaagaactcagataatttctaggtagaaagcaggtcagagaggctctagacctaggactctcgtgttggattgcttagtttcaaatcatgcttatgtcacttacatgcatgcaatctggataagacatttaatatctccccaagcctcagtgttctcatctgtaaaattagatgatgtggtgatgatgaaagaacatatataggctggatgcagtggctcatgcctgtaatcccggcattttaggaggatggggtgggcggggcacttggggtcaggagttgagaaccagtccggccaacatggtgaaactttgcctctaaagaaagtacaaaaatgagccaggcctggttgtgggcacctgtagtcccagctacttgggaggctgagacaggagaattgcttgaacccgggagacggaggttgcagtgagccaagatcataccactgcactgcagcctggacaatagagcaagactctgtctcaagaaaacccccaaaaaacaaaaaaaacaaaaataatatatataaaacatatatattatataatatataaaaaacatatataatataatatataaaacatatattatttaatatattatgtaatatctattttaataacatatattgtatattacataacttgttatattatataacatgttatataatatataatttgttatatatgttatataacatataaaccatgtattatatataatataatacatgttttatataatatataataattataatttatataatatatgacattatatattatatataacttatatatttatgtatgataaaatatatggtatatgaaatatacataattatatattatatgatataattatatatcatatatgtattatgtatatttcatatacattatattttattatataaacataagtatatattatactatgtaatagtataatatataattatacaatgtataattatatatgtaatagtataatatataatatacaatgtataattatatattatgatatgtatgacatacatatctaacatatattataacatgtatgttatatataacacatatagcatctagataccatgtatagcatgtgtacatgcatatatatttatgttattcaacatgggtccaggaatggagtaagagatcaacaaatacagtcattaaaatcagtgattcctcattcttctcccagctccttctttatgagattttgaaatccatatggatggataaaaatatccccaaatggtgcctaatgttgcagtgaaggaaaatgaaactctggaaataaaattagttcaaggagaaggagcatctccgctgttgacccggcttaacactagactaagaatagattgcaatggccccaacctcaggtatgccggataagtccctgaaggccctagaggggaacctgagaagggtttgaatgtttgcatgtgtgttcgacaagctggtacctggtagctgagatgtagaggagaatcattgtgccctatgtagagactggactatgtggactttttcatagctgtagacaaagacacgctgacagtaccagactggttttcaacctaatggcagcctcggggacaagggaaggtgaaaatggggctgcctatgaatggatgcgactcctcaggtttccatcagcctgaagtttggaagtgatctttggattaactgagtcggcagagtgttggaccacgagaaggcagatgtggagtgagatactggacttcttggctcctgtgagcaaagaggatgggcatgagattaaatggaaaagtaagagacgtgacagtttcccaggttaataacatgagtaatgccagttacatgcatgggagctcatttaacaactcttcagggttgtgttactacccaaaccctttatgatgctgagcacgcactgcagacactgattcctgcctgcccctccactctgtttcctggttaccttctgcctgattcattttgatctagacacactggcttccattcttttccatgaacaagccaagctccttcccacctctgggcctttgcacacgcagtttcctccacctggaatgctgctcccagatctttttacaacacatttcctctcatctgttgagcctcaccttacacgttaccctttcagaaagattttcccgttcatgtcctctccgctacattattctccctcccatcaccctctctaacatcatagtcctcaccattcctgaaatgatctttgttacttactgggtggcatgtttagaggctgctttccccactggctctgtgacagtgactttgtcatggtaactcaacattctgtttcctgtggcctgaagattgccgggtatatactaagtgctccatgaatatttgttggaagattcaatgaatcatatcttaccaatgcaatattggaagcctagagaaatgaaataacgttttcacaattgcacagagtaacagatgctttcagtgcttcccttgtatcttctaaccctttacctcttaagcatccactgacccatccaaatgtagttgcattctctttctgaggactttttctttttcttttctttttttttttttttgagatggagtctcactctgtcgcccaggctgaagtgcagtggcgtgatctcagctcacagcaatctccgcctcccaggttcaagcaattctcctgcctcagcctcctgagtagctggaattacaggcatgcaccaccatgcccagctattttttttttttttagtagatgtggggctttgccatgctggccaggctgtctcgaactcctgacctcaggtgatccacctgtcttggcctcccaaagtgctgggattacaggcatgagccaccatgcctggccctctttctgaggtctttttctggttgtactgtctttgcccacccgtatgatggcttggaagtcttggaggaatcaacacctgccctgggagcatccctccaccaggaactgatgagagttggtgtatgtggataactaccccatctccctcaccccttaggtcagataactatgaagcaagagctggtatgtgcatctttccccaagtccttgttcagggacaaggtagtgtgaaatcagccatggtgggaggatttacaccatggatatgggcagacactacaaatctgggcttttaatatttttctgcagtgttggttgttaaacatctaccagcacattgctagagatgttctacagtgtatcctagagttttccagcaagtttaagctccagttattgtcccaagtggtaacttgttttataatatgccctttactggctgcctccctgacctatttcatttcctgtgtcatgtttcatttacctcccacatagatgacttactcttggagtcttgtctcagggtctgattcttgggaaaccccgatgaaggcatacaactagtatgcgataaaaccagcatttaaacctaggaaggtctgactccaaatccacgtgtattttactaatactccactgcctcttgtgtctgaccagttctttgccaatacactgtgacaggagtcctttaaggagtgagacaaatgcattatattgatgaaagtagcttgcaattaagaagttagccttctaggccaggcacaggggctcaagcctataatcccaccatgattgggaggctggggcagggggatcacttgaggtcaggagttcaagaccagcctggtcaatatggtgaaaccccatctctactaaaattataaaaattagctgggcatggtgacgcacacctgtaatcccagctacttgagaggctgaggcaggagcatcacttgaattcaggaggcagaggttgcagtgagtcgggatcacaccactgcactccagcctgggtgatagagtgagactccatcgcaaaaaaaaaaaaaaaaaaaaaaaaaaaaaagaagttacgtttcttatgataagggatgggttaactagataaaacatgtggaaatctaatttagttagtaaattattttttatttcaaaaacacttttaaaacatagacatgttttccataaaacatgtaggcaccaagacagatttgattgctctcttgcgaatgatcagcagcaggcttccacttcatgcttgttataatttactgtttatagttcctaactctctgcttacacgctggtttgaatattcaagggtctcaccaagtggtgaggcactggacacaatgatgatgttgggtgcaaatgaatagggcttcagctggaaaggggcaaggggcagactggaaagagcttaggctttagacctctgtactggtcaggacactttggttcacaagggagagaaactcagtgcaagctagcctaggcagaaaagaaaaaagaacttaatgcctggggaaattggaaggttgaaggatgtgtagttagcttcaggtatggctcgatcaaggattactcgctaataaagcctctctccttcactagaatagaagctctgtaaagacaggcaccttgtctgccctattcatagctgcatcctccatcatatagaataatgcctggcacacagtgataataaaaattatagagcatgtcatatgggcatgccactgttcttagtttatccacttaacccaatgaggtaggcaattattaattataatccccatttttctgggtggagaaaccaaggcactgagaagtcatttagctgataagcagggtaactgggatttgaacctaggacctcttgctccagagtctgtgctcataaccatgctgctatattaactcagtaagtagttgttgattgagtgaatgaataactgactaatgatgaaacttgccagacacagagtattcagtaactaggagtgctgacatttatttgagtggcctctgttttctgtgtcccattagctttgggtgctggtgtcttcatctgcaggattccatatatttagcccagatcaatggagtgctggagggtcaggatgagtcgtgttcaagaaaataaggttggagttatttctagaattttttttttttttttgagacagagtctcgctctgtcgcccaggctggagtgcaatggtgtgatctcggctcactgcaacctctgcctcccaggttcaagtgattctcatgcctcagcctcccaagtagctgggattacaggtacccaccaccatgcttggctaatttttgtatttttagtagagatggggtttctccatgttgaccaggctggtgtcgaactcctgacctcaagtgatccactggccttggcctcccaatgtgctgggattacaggtgtgagacaccacacccagcctgaaattttgttttaagttcctgagatccaggggttgtttgttactgcagcatagtctaacccatcctgtgtagaagcccttacttacttaggatgtgtcattgagttcagagagaggcagtagaggaaagggcccagactttaaaatcagagagatgaaattccaactctccactcactagctgtgtgaccttgggtaagttccttaacctctctgagcctcactctgcattctcactagtgaaattacaactgtaattgctactccatgaaattgctttgactactaaaataggaaaccctgtcaagggtataacatagtaggtgttgatgtatgttggctattacttttgctattatgtagcaaagcatagattactttggctattttgaaaaaacctgttgctatcaattaaggatagagtggctaaattaagtaaattctgtaagcaaacaaggatgggtctttaattctcctccacttttgatttatggctgaagatttgacagttatctgaagtctgactagcttgaaaaccaagacatctgtgattagacttaccttttgttcttcccattagtgtaatacattgttttaggacatctctgccaacccactcccccaatatccatctagcttggagcctttatggccttcataaggacccggcttcccccttggtctttaaaattagacaacagatgttcataatcgaacctgtcttggttccagaaagtctgagatgttcagaaataatcagaacgtctctataaatatcataaaggatatatcattttggcagaaccagatccagtttttgtggggactgaagcttatataatatggggatctctgtttaagaaaaagaatacaaaattatgaatttaaaattaggcacaaaagagaatgttattttggaatgagaaattaagtataatattcctgtagctgcctggacatggtagctcatgcctgtaatcccagctttttgagacgccaaggtaggaggatttcttgagcccaggagttcaagaccagcctaagcaacatggcaagacccccatctctacaaaaaaaaaaattcaaaaaattagccaggtgtggtggtgtgtgcctgtagtcccagctactcaggaggccgaggtgggaggatcgcttgagccagggagttggaggctgcagtgagcgatgatcttgccaccacactccagcctccagcctgggggtaacagagtgagatgttgtctcaaaaaaataaaaagagaaaattctggagcctttagctatttccattccattcttctgggatctgtgtaggcaattaatcagaaatgtgaacatagaggtgcttcattattgaaacccagctttcccttctcacctaaagccttccccaagtccagcatttaaagagacaggtacaaggaaaagaccctgaagcccaagcctcattagcttcaggtaaattcacctccgctctctggagaagcagacaacagaggcctcttgtgaatattgaggagaaggttgtatgtgtgttcatgtgcgtgagatccaagtggagagcatgggaacctagctcaattttcccttgaggtgagcttgaagctttgggtatcttcctctcagagaacgtaaacccatttttccaacattgttgtaaaatattctgttcccacctttcccacaatcagcttgcctgaccccaccacagggtgtgtcatcttgtgcttctggcacacacacacacacacacacacacacacacacacacacacacactctcagagccctgccatctgaaggcagccagctccagaaaggccaacccttagctgtaactcagcatagcactgttcatgatctttggtttccatttctaggctggtttccttttttgttttgttttttcctttgccaagactgtagttgaaataggataaaggatttatttttccataacaaggtaggagaaagggtgctaggttacaagcaccctgtcaatatcagagttggaagcttcttcctaccatcaggtgtgtgttgtgaaaggaacgaggggttcaggcaagtatttcccagcaggtgggaaggggtcttgatgggatggaaactaggaaaacaaaccagattccctgagggaaaatcaactgttcctgaactgttatcagtgtgggagtagggttcacagatttcatattctaaacatgtttgtgtgtggtgtgtgcacacacacctactatgtggcagagcctgtcataagtggtgatggattcctgtagatatagtttgctggagctgccataacaaagtactacagactgggtggcttaaatgacagagattaattttctcacaattctggaggctggaagtctgagatcagggtgtcagcagggttggttcctccgaagacctcctcttggcttgcagatggtcgattctggtgtgtcctcagatggtctttcctctgtgcctgtccatccctggtgtctctctgtgtgtcctaatctcctcttcctataagaacacgagtctgattggattagagctcaccctaaatgagctaaataggtttaaacttaatcacctatttaaagcccctatctccaaatacaatgacagtctgaggtgctagggggttaggacttcaacatatgatccatatggttgaagggcttcaaattcatatatatatatatatatatatatatatatatatatatatatagagagagagagagagagagagagagagagagagagagagagagagacagagagacagagagagagagacagagtctcgttctgtcgcctaggctggagtgcagtggtgcgatcttggctcactgccacttccacctcccaggttcaagtgattctcctatcctggcctcccaagtagctgggatgataggcatgcgtcaccacacctggctaatttttgtatttttagtagagatggggtttcgccatgttggccaggctggtctcaaactgctgacctaagatgatctgcccacctcggcctcccagagtactgggattacaggcatgagccactgtgcctggcctcaaattcatatttgaacatttattcaaatttgaattttagggggacataattcagcctgtagcactgtcaacctaaaaggaagaagctgaggcaaaattaatgtaagtaaagactctgtttgggccaagcttgaggactgtagccagggagcgtagattcaagtttccctgaatatacactccaattagcagcagttacaagtggatttataaaggcaaaaaagggggacatggagtgggctggtacacagttggttgtcaggaattctcactggttttcagaaataacattgacgagtgattggctatacattgttaagctatgaggtgtgggttatagcatccagtggggcattattagattaatttatagctacttgtggcaatggcaagcagttttaagaaatgaataccgagctcaaagggggtatgtaggacatgattgctatctcattctattgcctctctgggcctaataatttaaaaggcttgtattcctcagatgaaagttctgttcttttctcagcaccttgaatggctggagagagcaccaccccatccttgaccatgctgagtgctggctggacttcaactgggccagtactcccttttcccttgtggaaggtcccctgattaatgcttacctgaacgcctgctcttccttcagtccccagttctctgcattccccagcactgggaacagagacagcatgtctgtgttatacaatagggaagagtatgggctctgggtttaaactttgactctgcccccttgttagcccagcgactgtgagcaagtcatttcacttcacccaacttgttttcctttttgtacattggaggttactaaaagcaccttacctgtccaattgtagagaggattaggtgtattaatgggcatggcacagtaaacactcacaaaatgctagctactattaattgtcaagattatgttggttgcaaggagcagaaactcatatggaagtcatttaggcaataaaaggggataatttattgactctcataaccaaatccaggaaggtaggagagcagttgagtggcaggggcaactggaaagagaccattccccatgtctgtctgtctgtcatatcttttttatttttatatatgtatttttttaccatggtgggtttttttttgtttcttttctttttttggttgttttttccatccttggctagaaccatggctgccaacaagcttctctgtttcataatgggagaccttctcatgtggttatgatgtgaaaaaaatcccagggaaggactctgattggttcagctcaggtcacatagccacccacgtggccaggtcaggggctggggtgcttaggtggggcagggggttctgggtagataaaaataattaatgccttctgccttatctaaatgttctttgtactatgcctggcacttggtagaaattaaacaaattcccctttttccctttctgtttgaccctcatgtctactttttattacataaaagagtaatccagaaaagaaagtcagctcattggagacactgggtagggagaaaaagctttttatagaatattaggtaggagtagtggcttaggatggtaagagctctgcacgaaaggaagacattacggtctaaggccacctgggagatctgagtcaagcagctctatcccttcctgaggacaaaagagatttcaggcaatgactcatttgtttggagagctaattgacaagacatattaagagttttagcaattgttcatgctttttgatccaacaaattcacttctagagtgtcaagaactgtgctggtctaagatattatcctacatggaggctagtgagttttatggatgtgggcagaagacatgagactctggattgagagataaaggactttatttttcatggcacaacaggaagcttgagcttcatgtctgcaccagttccctttgacccccaagtccctcaagggtgacacaggttgacatggtttggctgtgtccccacccaaatctcatcttgaattgtagttcccacaatccccatgtgtcatggaagggacccagtgggaggtaatttaatcatgggggcagttatcttcatgctgttcttatgatagtgaatgagttctcacaaaatctgatggttttataaggggctttttcttcttttgctcattcttcccctttctgccgccatgtgaagaaggacatgtttgctttcccttctgccatgattgtaagtttcccgaggcctccctgagtcaattaaatctctttcctttatgaattactcagtctagggtatgtttttcatttgtttgtttttttgttttttttgagacagagtttcactcttgtcgcccaggctggagtgcaatggcaggatctcagctcaccccaacctctgcctcccaggttcaagcaattgtcctgcctcagcctcctgagtagctgggattacagccatgtaccaccacacccagctaattttgtgtatctagtagagatggggtttctccatgttggtcaggctggtcttgaactcctgacctcaggtgatctgcccacctcagcatcccaaagtgctgagattacagccatgcctagccttttttttttctttttttgagacagagtctcactctgtcgcccaggctggagtgcagtggcgcattcttggctcactgcaacctccacctcccgggttcaagcgattctcccacctcagcctcctgagtagctaggattataggtgtgcaccacaatacctggctaattttttgtattttagtagagatgaggtttcaccatgttgcccaggctggtctcaaactcctgagctcaggcaatctgcccacctcggcctcccaaggtgttaggattacaggtgtgagacaccacacccagccttgggtatgtttttattagcagtgtgagaaatgagtaatacatggatggatccaggtagaatctgtgcctgcagtggatttgcatcacacctgaggaaccccaagtttaggaatcttggtcttttcaacctttaccctggatggagggagacattgtcattataatcctttctttttctttttcttcttctttttttgttttttgtttttttgaggtagagtcttgctctgtcacaccaatgttggagtgcagtggaatgatcttagctcattgcaacccctgcctcttgggttcaagcaattctcccacctgtctcccaagtagctgggattacaggcgcccaccaccacacccagctaattttttaagtgtttgtagtagagatggcagtttcaccatattggccaggctggtctcgaactcccaacctcaggtcatctgcctgcctcagcctcacaaattggtgggattacaggcatgagccactgcgcctggtccggagatattattattataatcctaatcagcaaataaatctgtcttctactatactagccctatcttctaatgctattagctatacaaacatccttataaagacggtctagaacaaaagctgacacaagatgtgcagaaatgtaagagacacatggggaattgttgcacagcatagagaatctttcctaaggaaactacatctgaaacacacacagaaaatgtattcttaaagcaacaatagttcagcattaggggaagaggttaaacagactgttgttgggatactcttctgtttctaaacatgtttctgaagatcttggaatgggaagtgtaaacgttcaacttaaaatgtaaagtggaacaaaaagctgcaaaacttgaatatatgtttttattaactatgtacagacatctattctaggaaacctgggagggagacgtgctaaaatgttcatagtctttctctgggcgatgagtctaggatccactgtttttcttcatttggaatgttcatagtcctcctctgggcaatgagtctaggatcaactgtttttcttcatgtggaatgttcatagtcttcctctgggcaatgagtctaggagccactgtttttcttcatttggaatgttcatagtcctcctctgggcaatgagtctaggatcaactgtttttcttcatgtggaatgttcatagtcttcctctgggcaatgagtctaggagccactgtttttcttcatgtggaatgttcatagtcttcctctgggcaatgagtctaggatcaactgtttttcttcatttggaatttttttttttcagtttttctataatgaacatgtattacatttataatagaaaataacaagataaattatttctgaaagcagtgcccagcatccagaatttggcaaaaacaggagaagaaagcataaaacaagcagggaaaaaggttttcagttaaattagatgtccaatgaagagatcagcttggctgcaaaatctctttttgacagacaattagttctgggcaagtcaaatgtttcaacagtgcgttcttctggggcaattaaagtaattcatacttgatgtgcggaaatgtggtaattgggaaagttccccaaatggcagttgaaactgggctggttgtgtttggagaagttaagtcatgcccttgacaagccatctatctgagtctactgaagagggcttgggctgggtgattttaagatggaattttccactgggcataggaagtgatgttgggaatggactagaagggtcaacagtgacaacattaacagcatttattgtaatataaatacagttggcccttgaacaacatggatttgaaccgcatgggtccacttatacatggatttttttctgtttttgccacctctgagacggcgaaaccaattcctcctcttcctcctcttcctcagtctcctcaatgtgaagacaatgaggatgaagacatttatgatgatccacttccacttaatgaataataaatacattttctcttccttatgattttcttaatcatatattgttttctctagcttattttattgtaaaaatacagtgtataatcatataaaatacaacatatgtgtatattgtttgtgttattggtaagacttctggtcaacaataggttattagtagctacgttttgggggagtcaaaagttataggtggatttccaactgtgagggggttggcatcacagtcattcatgggtcaaccattgtgtcaataacaatcataccacacatattttgagtgccacatgttgcactaagcacttatgtatctattaatttctacaactatcccgtgcaatagatacgattggagtttccgtcttactgataaggaaactgagggccagagaggtcaattgagttgtccaaggtcacacagccagttagtaatggagctggaatctgaatccatgcaatctgacccttgttcaatgctcctagacttatgtgctggatttttttttttttgaaataacaatgttttatacctctatctttactttcctagataagggcatctgatttccctccatggcaagcaagttatgttgtatttgctacatttgagagggaaaaaagctgaagttcagaacggattagaaatttcccaaggccacacagtgaaagaatagaaagtttccttttttaaatggcggagcttttatatcaatgctgtttgtaaattttagttggcaatgtctgttatattccatgaaactgaatgagaggtgaggtggtatattagccaaaactctctcagctacatcttgctattgttccatgcaacttcaaagcccacagatagactggacttcaagtatggctggatccagatgcttaaatgatatgctttgaaatctgtctgatctctacttctcagctctcttttcatccatgttggcttcattatcaggcccttttcttatgccatcagcagctgctgacttacctcctaccagcttagtaatcccaggggaaaatgaacttacctttgccaaaagcactggcataagaagctgactctcattgcattgtaagagtcaggtgcccatctctgaacgaattattgtggctaaggaagtagaagagggtgattagtcagtcctgatcatgtgctcagctctagctttagaagatggtgctatccaaactccatgaatgaacagtgaaggaaggaccattgttcaaaagtaagtggaaatgctgtttccaggaaagcagaatgggaggaggaagtggggggaggggggaagggattcaaggggtgggagctggaatggaattagccctaaatagttggagtttggagggtgtaagtaagtgtgagctgaatgccgaaagcagagttgcaagatggtgtgtcagcccagttctgagaaacaaactcccatacaggattacacatatgtgatttttattaagggaaatgcccttgagagaaagcaaagaaggtgccacataaagctgggagaacctgagacagtaatgcaagtctgactctgagtaaaagagagaggagaaaaaagttagggtgcgaacaccatagggaagtccctaagccaaagccggggacaggggaatcctgtgtctcccggggaggggtctgctttagtgtccctgccatgctcagtcattagccaggagcacctcatggaaggaagcatatggattccccagcgcagcagctggggccctggttaattacactcccagtagagggaggtcgatgaggcccattctcagggccaccacatggtgagccatgcagcagtggcctggcagaacatttgtctgggttcatacagtatttacattaaaaaaaatcagggctgggtgctgtggctcacacctgtaactccagcattctgggaggccaaggcaggcagatcacttgagattaggagctggagaccagcgtggccaacaagggggaaacctcatctctactaaaaatacaaaaattagctgggtatggtggtgcacccctgtaatcccagctacttaggaggctgaggcaggagaatttcttgaatgtgggaggaggaggctgcagtgagctgcgatcatgccactgcactccagcctgggcaacagagtgagactcttgtctcaaaaaaaaaaaaaaaaatcagttgccagcattcaacaaactgtgtattttacatctttaaaaacccctggatttcctgcttctctttaaaaaatagtggcagtttggcaacattgggagtccattccacaaatcttgcaaaattgagtcctcgctgcctccttagataaggtgtgtgctctctagtttgccacagtctccaccagacccagttgccctaatctgtactcttcactcatttgtgttacttgtctgcccatgtgtgcatttaagtttgcaacccttgccttaaattcatctgagaaacaaactatggcagtcaggttcagccatagaatctaatgggaaggagcaaagctggagattgagcgactaagctagaggttgataaagcaggaatagagcaggtagctggagtctgagcagacagacttcagggcttgtctgccttcctaagagctcctttgctggctgggtgaagtcactgagaacctaagcagagggtgtcagttctagccttcctggagaaatcttagttgagatggatgtttagagctggtggacactgcctttgtgtcaagccagtctaggagtcacagcaatatttggacactggttgaaagttgttccattccatcccacttgctcagcaatttggacaagtgtgggtttaggttattttaattggttaatacccttttgtttaggtgctctcctttcctcttccacatggttcagtaaggctgccaattctagagctctttcttctcctatgaaagtcatggatgtcttaggctgggttttcccagaggcagatcctgtgatgaggatttccatgtaatggtttatttgtagggtgactctgggaagcaccagtaggagaatgggagtgtattagtcagggttctttagagaagtagaaccaatagaatagcacacacacatacacacacacatatgcatatacatacacacacacacacacacacacatatataagcatatggggaatccatatgcttccttccatgaggtgctcctggctaatgactgagcatggcagggacactaaagcagacctctccccaggagacacaggattcccctgtccccagctttggcttagagacttctctatggtccatatatatatatatatatatatatatatgtgtgtgtgtgtgtgtgtgtgtgtgtgtatacacacatatacatgtgtgtatatatacacacatatacatgtgtgtatatatacacacatgtatatgtacacacacatatgtgtgtgtatgtgtgtatatatatatatacacatacatatatgtatctatatgcacttttatatacatacattcacatacatatatgtatctatatgcacttttatatatatgtgtgtgtgtgtgtgtatgcaattatggaggctgacaagtcctaagatctgcaggatgagtcagtaagctggagacccaggagacccagtggtgtagttccagtctgaaaaccagcaggcttgagatccagaaagagccgtgtttcagtttgagtctaaaggcaggaaaattttgacgtttcagcttgaaggccctcaggcaggaggagatctctctgactcaggcaagggttggccttttgttctatttagaccttcaactgattggatgaggaccatgcacatctggagtgcaacctgctttcctccgtctacccatttaaatgttaatctcgtctgaaaacaccttcacgggaacacccagaataatgttttaccaattatctgggcactcagcgtcccagtcaggttgacacataaaattaaccatcacagggcaaaatgagacaaggaaatctaaaccagaatagagcaaggtaatgagtaagttacttctatgggcagccggggcttggtccttttgatgggctttggttgatggcatggaacacacctcaaattgtcccacctgagtgttgagaaaactgagatatttatctttcatcactcatctgacattgaccaagggatgctctcagggactttgacatccttgaacttctggcctgtcttgccgaggccaagaaaaggccttcaggtggggagttgcaggtgcttgcagagggatgccttcagcttgtatgggatggggagggtccaagggacatgggtggccattgccagtgtctgctatggttggtaagtggcacatatctggtcaaacatcaggatctatccacccagcagtgttggaccttggagtggcacaggcatcagaatcttccctggggattaacttattgtggttcttgaacagagaggatatatatctggaggtgccagcctctacttgccctcccacatggagagagatggagaataaggctgagcaaagacaaacagtgaagagaaatggagacagagagagggagagagagagtgagagagagagagagagacagagagagagagagagagagagacagagacagagagagagagagagagagagagagagagagagagtatacatgtactttgaggcagtgagtcctgtttctagtccctggggctctggttcttttctcttcctgtcttagtctgtttttgctgctgtaacaaaatacccaagactagataacttataaaggacagaaacttatttctcaccgttctggaggctgaggagtccagggtcaaggcacaggcacattttgtgtctggtaaggggctctgttccttgcttctaaggtggtaccttgtgtcctctggagggcatgaatgctgtatcctcatatgtggaagttggaagggcaaaagggcctaagttagttccctctacccctttataaggcatgaattcattccttaagggccaagccctcctgactgaatcacttcctaaaaggcctcacctcttaataccactgcaatgaggattaagtttcaacatgaattttggaggagacacgttcaaaccttagcattccctttccgtaaatgacctcagctggataaaccagtatattcgtttcttgattaatttagccagagttagatttctgggcatgcaaccaaaagctcttactaacagttattgtggtgggatagggatgaggggaagggagattgggattgagagagagattgccctgggcctaagagctttctctccttattacatcccagtgcctgagatttaagttgctagaaggaagatgagtttatggtggaaatttgtaaccgaccattaactagaatggcgcagctaagcccctgtgcctgaccaattgttaggacttaaagaaatagcaataaagaaagagcttttagtttcagagcttaattagccattcttttccttcctgacttttagttttatgactctagcttccaggatagaattttattgtagtcagatacaaattaaacccaaacaaggactctcccgtgtttctgtttcttcaatttaaatttattctttgtagggtgacactaagtaccacagtatatgtcacatgtaagaacagtaaatttttaaaaaagagagacagggcaagcatttatcattgtgatctcttctctaaacataatgggaacttaggttaattaaaaaaaaaagttaatgccgttgttttttgccttaagaaaggtagggtttttatctgaagtgctctgagaattggcactcttaaatctgcaatgatgagaaataacagtagctaccatttgttgaaaatctattagtagtatgctaggtccttaaccttcagtatctctaattaccccaagacacttgaaggatggatggtctaaagtttccatgtgtgcaaaatgatagctctgagaagacttaaccaatgtttcaaagatttaaaaaaaaaaaaaaaggaattggagccagtttgcattaagaccttttgaactccaaaaaatctatctatgtgcttccgacttgaaaagggtatgttttgcatgctggatatgggtttggtggaggtgctggtgtatacactgtatgtttcaatgctagacatcgtgctgggtactggacttagtaggcacctgatcgcatttctgttcggcaaattcagaaaatgtgagtgactgaaacttcattaggttgaaggggaatttaccttttcactacgtctgagcaaagggtttattcggtaaggtatatttatattatattatattatattatattatattatattatattatattagtgccccatggaaattatatttgtttctctacagataacaaagattcttatttctctcttaaaattcaaaataaagagccttactgacatctaccataaatcctctgctgtaaccaggtagagtataaataactccataaaaagagagtaatgctgtcttgcgtttgcacagcactttacagtttagaaagtatttgcttgccatgtccctttcgatcctcctgataggcttgcggggtaggaaggagaggtactgtcatttccatcttcctggtgggaaacaaacatttggagaagttgggtgacttgccccaaggtgacacaatagtgaagggttcaaaccaggacttagttagtttgggtgtcagaatgggtcagagtgggtttgtcttagttagtttgggctgtgtattagtctcttcttgcattgttataaagaaatacctgagactgggtaatttataaagaaaagaggtttaattggctcacagttttgcaggctgtacaggaagcatagctgaggaagcctcaggaaacttacaatcatggcagaaggtgaaagggaagctggcatgtcctacatagctggagtaggaggaagagagcaaaggggaaagtgctacacacttttaaacaaccagatcttgtgagaactcactcactgtcatgagaacagcaaggggcaagtctgtccccgtgatccaatccccttcccccaggcccctcctccaacactggggattacgattcaacacgagatttgggcggggacacaaatccgaaccatatcaggctgcaataacaaaatagtataaactggatggcttaagcaacagaaatctatttctcacagttttggaggctgagaagtgccacaatctggctgatgtagctcccagcggaccctcctcctggcttgcagaaagctgctttctctctgcattctcacatgacggaggaagtggggggtggggggagcggaggtagagagggagagagagagggagggagggaagaggagagacagagcaagagagcaagccgtctggtgtcttttcttgtaaggatgctaattccatcacgaagacctcatcctcatgatctcatctaaactaatagtcttccaaaaaagcccacctcctaataccaacataatggaagttaaggcttcaacatatcaattttgaggggacacagttcagtccattggacttagagttcacacttcctggacaagattttggaacgttgtaaagctttcttcagaaaaacaactagtttattttcccccaagcatttatagcccactttagcagcactcaactgcatgcctctgatctatatgctaattttggatccgccttatctcttaagtaatccaagagtttgtgtgtgtgtggatgctccttgatttgaaatccttatgtgcttagaactaatggcgttgtaaaacacactccacaatgtacccttctctaattcagcctgattttctcccatccctccacgttagccgggctcccatgcccctgtttttgatcacgattgattgtccagctccaaagcatcatctgaacgacttatggtctttctcccgagtgttggagcccagggtaggcagatgggagagggtaggggatttgaaccggagaaagacatttaaatttcctcctgttcatcttagcttaggaagttacctgctgtctgaagggtgtatccctattttattatttatttatttttacaaaaccaagggaaaccagcaacgaaacgcaagaggagctcctctgcctctgattccagtagctgtgctctcaggttggagcagccaacccagaaattggtggccagtggctagggtcaggatgagcagagtgaacgcgagttctatgtctgattataaaaactgtacttgctccttatggagaatttgaaatctagggaaattataaaaatgtaaagtgttatcagtcctttgtcagccattgggctggttggttggtcagaagtcatcactgttatagaccctcattgcttaatgaaaattaatttgtcaagcgatttccttgatgatgctaatatttattgaaaggttaccctaggctgagttctggctaacagctatatatatgtatacttttattttccaagtgaagaaacaggctcagagagggtaagaacttactcacagtcacacagcaactgagtggggcggctagaatttgggttcagatagtcagacgttagagttcaggtttttcatcccttcaacatctacacatttttcaagaaataacaagattcacttttggtttgaagaggagtgcatgggagagaaagaaaagtaccaaatgggaaaaagagagagcaaggaaaccaaactccgtttgtggtcgtgagctacattaaaaaaaaaaaaaaaaaaaaaaagccaggccagggacaatggctggattatgcctgtaatcctgccactttgggaggccaaggcaggaggatcacttgaggtcagaagtttgagaccagcctgggtaatatagcgagaccccatctctacaattcttttctttttcttttttttctttttttgaattagcaaggcgtgctggtgtgcacctgtagccacagctactggggaggctgaagcaggaggatcgcttgagcccaggagttcaaggctgcagtgagctatgatcccaccactgcactccagcctgagcaacagagtgagactctctctgaaaaaacaacaacaacaaaaacaaaaacaaagcaaagctggtggtttcacatgagtgttgctccttctggaaaggcatcactggagtgggtgccatattttgatgctgctgctgccaatgatgagaacatgggcaacctcttttgcctgtaattttttttttttttttgagacagtctcactctgtcacccaggctggagtgcagtagtgcattctcagctcactgcaacctccgcctcctgggttcaagcgattctcctgcctcagcctcccgagtagctgggattacagccgcctgcatccacacccagctaatttttgtatttttagtagagatgggattttgccatgttggtgaggctggtctcgaactcctgacctcgtgatccgcccgcctcggccttccaaagtgctgggattacaggcgtgagccaccgtgcccggccaagagagacttttctacactttgtaattatgttatttttaaactgaaaactatatttcctatttcttagtgttagaaagaaagagaaatccctgagaacaatcagcagcctggagcatagtttgagactcccactaacagagccaagagtctcaaactaggccaacagatacccttggggaaccctgctgtatccctgggacataaaaaactacagtacaaacatcatcatcttcctggaggatgaataaactttagtagagtaatagtaacttaaaacacatgtggcacaaaatagaacgcagagttcacaaatacctaaggtaaaataagacttcaaagaaaatttcacccttgcagaggttattttgggctacactccacagagtatgaattcattctcttttcctctcagggatagtttgttaagagtctgaaaaccactgctctgggcaaactgccctccggagtcacacacaaaaaatcaatctcgttactaaagataaattttatttcaataaaaattgtaatgagcttgatcacctacccttttcacctgacttggctacaaatgactgccaactgtttaaaaaaaaaaatccaaccgaccctcagagctaatatgctattacttttaaagattacagacaggccaggcgtggtggctcacgcctgtaatcccagcactctgggaggccaagttcctatttcttagtgttagaaagaaagagagagaaatccctcagaacaatcagcagcctggagcatagtttgagactcccactaacagagccaagagtctcaaactaggccaacaggcacccttggggaactctgctgaggctgaggcaggagaattcccggaacccgggaggcggaggttgcagtgagctgagatcgcgccattgcacttcagcctgggcagcgagagcgagactcggtctcaaaaaaataaaaaaataaaaaagcctctcttgtgtccttgtccccagccttccagctctcctctgagggaaccagttttcaagatggcccgcaacaatccctgcctgctgccattcacaccttgtttagtcccctcccacgctggaaagatccatgttggggctcgtgtgtgaccaatgccgcagaagtgatgttatgtcacttccgcgattacgtcatgaaagactgcagcttccattgttggctctttctttctctttcttggatcagtcgctttggaggaagccagctgccatgttttgaggacactaaggcactttacggagaggcccacgtggtgaggaattgaggtttctaagagccagtaaggaatagagacaaccacacagtgagcctggaagcctagtcttcagccccagaaacgctcagatgactgcagtcctggctgacatcttacctgcagcctcattggagaccctaagccagagcacttagctgagttggcttgtgggttccaaatccagacaattagatgataaatgcttgttgttttatatttagttttagtttttgtgactacatcgtaggtgtatatatttatgggttacgtgagatattataggcatgcaatgtgtaattatcacatcaggctaaatggggtatccatcatctcaagcgttttcctttgtgttacaatctaattattctcttttagttattctaaaatgtacgattaaattgtttttgattatagtcaccccattgtgctagcaaatagtaggtcttattcattctttttttttttttttttgagatggagtcttgctctgtcgcccaggctggagtgcagtggtgcgatcttggctcactgcaacctctgcctcccaggttccaggaattctcctgcctcagcctcctgggtagctgggactacaggcgcctgtcaccacgcccggctaacttttgtattttttagtagagacggggtttcaccatattgaccgggctggtctcgaagtcctgacctcgtgatccacccaccttggcctcccaaagtgttgggattacaggagtaagccaccgcgcccggccttattcattctttctaactatttttttgtactatcatggttcactgcagcctcattttgacctcctgggctcaaattgatcctcccaccccagcctcctgagtagctgggactgtatgcacatgccaccatacctaggtaatttttaaagattcttttatagagatggggtcttcttatgttgcccaggctcgtctcaaactcctgggctcaagtgatcctcccgcctctgcttcccaaagtgctgggataacaggcgtgagccactgcacccagtcgatggcgtgtattaaaaggaatgatgatataaatactgatgactaacatttattgagtgttttttccatgtcaggcattatatcaagcactttacatgcatatctcatcagtaaaacatttgcatttttatttcttatcactagtaaatccttctcctcccagaagcatttaaaaatccacaaaccatggctaacttcctgtgaaatggcttagtgggcaaaaattcagaataaggggagtgtgagtccatgtctcctttccagagatgaagaagtttctcttttctgtgcatgaagaagacaatgggatatggatgacactaaacctttgaaagttcctgctaacctccaggtggaaggaaagggcccacggtgatcaataaatgtgtttgctattttttgggtgaaaggaagagagcctgcacctctgttggggtaggttatccacgctgtctgcctggggtccagattcctggcattgatatgacttcttggctctcttgagccctgaatctgcttcaaattcagaaagccccaagacttctgggctctataattactctgggctttggagaatggtttctcttatgagcaaaacaatggtggaaacttgtaccaatgaaggaaacacacaagcgtgtagaggaacattgctgtttgctgatgatgctggtggctgcttgggtgagagataaactctccaaagagcgttggcccttttgtggctgcaggatctgggtgaaagagattcttgtagtctatcctatcactagatactatctgtcttagtccattttgtgctgctataacagaataccacagaccaggtaatttacaatgaatagaaatttacttgggtcacagtcctggaggctgggaagtccgaggttgagagcttacatctggtgaaggccttcttgctgcatcatggtgtgacccaaggcatcacatgggtgagagagagggtgagagagagcacctactcctgtgaaaaccagcccgctcccatgataaaggcattaatccattcagaaagatgatgtccccatgatccaaacacctcttgaaggcctcacctctcaacacggttgcatcagggattaagtttccagcacttgaactttggggaacacatgcaaaccatagcaatatctgtgccggatattttgtatttgctcctttacatccactgtccacccccatttcctgctttgtaccccaggaggctgacttctatggactacatcacatgtggtctcccatcctcttgtggctgcttgggtttggccaatggggtggggatcatagaatactagaaggtgggaggagagagggattcggatatttatttctgtggctccttcctgttgggttgccataggttggaagctcctgccaggcagctgtctttccctgaagactgtggctactctccttgggttccataactatttctcctccaggtctaggggtagaaatggctcctcactgctgctagttagggctactgcaacctccctttttgtttttgttttttttaatcccacttatacagctatatatagccctttgctaaactctttttagttaccccatttgagtttactatgtatttcctgccacaaccttgattgatacagcagcccagagaagggaagcaattaactttctcactcctttattcattcatccaacctcccatcaacacttactctatgccaggacttgtgctgaggcttttaagaatgagacatgatttcttgtctatgtccctgagttctcagttgttcaccccagaaactgactcttaccaaagaaagagaacatgccgaaggcattgctgaaggcccagccttggaaaacaccccatacaaggtgactccagatagctttatagcggcaactcctccaagggcatgcgttagggataggctgatctggggacccctgctctccctgcagagaattcatggaaacccaatagggcctgtgttcttgcatcatgagtcaaggtgccaagagagatcacctgattggctgatccagagtcacacggttgggggagggtatacaaagtggagggctcaccacagcggtcagagataaggctgctccttgcagctctgttttttgcaattcctcttggaccctccccagttcggccaccacccttgaggctagcaagggtgagttgtgtcagaagcattccatgcaaggaaataacaacttggaatccaaatatattcattagtaagtaatggaaacctgaaattgcttaaacaagatgggacattattctctcacattaaaaggaatttgggggtaggtgagtctagggttggtttattcagtagttcagttgtatcatcaaagacctgggctcttgccatctttgtgctctgacttacagagcaagggcttaattccagtcttttcctctaatgagcacaaaatgggtgccacagtgccttacatcacatcctaacacaataacgttcaatgtccaaaggtcagaggagaaaatgtgtcttccttgtgtccattgttgacagcaaggaggaaatttccatcaactctcattggtcacaatgggtcacgtgcctattcgaaagcaatcactagacagggggtcagtattactatgattagtttaggtcagtcaagattcactccttgaggctcagaagggcaacttctcctaaagcatgtgactgttcaatactttaaaaattggggttctcttagcaacggagaagagaggctctttttttgacaagcaatcgtagcatctatcaaagcataagaaaagcttgtgagtgatgaggttggagactgagaaggttccagaacatgacattctggtgaagtaggcaggacccaggaatctcaaaagtgacccaatgtcacagagtctgttggtggcagaggaattgaggcatctagaggcatctaggcagagtgattgaggcatctcactttctacgcagaaaaggaggcatttgctccacaaaagcctcctgctaattccagggacctttcgctgtagagacaactttatggcatcagtgacaactttggcctcattgtcctgacagagcctagaatggtgctatctttgggcttcatatctgtgaggcactcagaaatgtatgaagcatttccaagtccatggtctcatttgctctccactttgcagtggggaaactgaggttcagacaggtgaagagacccgatcaaggtcacatagctggagagcaggaaacactgagctcaaccccagatattttaaccaaaggttttagttctctgccttcctgccttctagataactccatacagtctgcagggtagatcctcaatcatgatgtatgaaaagcgtgaatgaatgcaaaaaaaaaaaaaaaaggtttaaaaaagctgtgcaagctgggcacagtggctcacacctgtaatctcagcaatttgggaggccaaggtgggagaatgtcttgaggccaggagtttgagactagcctgggcaacatagtgagactccttttctataaaaaatttaaaaattagctgggtatggtggtgtgcatctgtagtcccagctacttggaaggcctaggtgggaggatcacttgagcccaggagttcaagaccagcctgagcaacctagggagagcccgtctctacaaaaactaatataaattagcaaggtgtggaagtgcatttctgtaatcccatctacttgggaggctgaggtgggaggattgcttgggcacaggaggtcgaggctgcagtgagctgtgatcacacaactgcacttccagcctgggtgacagagtgagaccctgtctcaaaaaataaaaaagttgtgcaaagataaaaacccagttatgactcccattgtggacccataaataaagcaaagttatcaaatagagatgtgtgagctgctgaatggaacagaactcactgggtttatggggctgtgtcaggcacctctgacaatgccagatatttactttgcagatgaatgacttcattgcttgccccaaatgcatcactggtgggtaatatttatgcagattggaagcattctccctcctttatatggtcctgggctgtttgtaaccattggatttttttaccttttgacttgacgttgttcttcacgggaccgtggtatgggatgcatttcaataaacaataccaaaggacagatttcggctttaaataaaattgtgttccgtaaagtgggagacaaaggcttataactcactgtcggctgcagacattttggcaaaaattatctttcaggctttgatctccactgtatcattttactgagtggccccatgtgctctatcaatcaaacccactgaagatgcaggagaatcacatttaaaatcaaatacaaattgtagattcatctgcccaggaggaagagaaatgtgtcatgaatcctgccttcagtcttctatgattacaacggaattagtttttgaaaactccagaggatggttttccacttcccaactttcatattattattattatttttgaagggggtaacattagatgggtagagaggtagactaaagtgattcagctgtgagatcggagtctcgccttccatctaactgtaggttagggccttttaatattcctctgacagagattctttatgtaggaagggatgttaagaagaaagatgttctctaacaagaaaacatttagacaaagaggatatgacctccctcactcaatctcgcctgctttcttggcatacatgggaagagaggatgaactagaaaggaaatattatttgctgatctcctttctttgtctgaggcacattgcacaggatgtctcatttgatattcacatgcccatgtgaggtgaacaatccacaccatgctttacagaaggggaaactgaggtcaagaaacatgctcatgggccgggcgcggtggctcacacttgtaatcccagcactttgggaggctgaggtgggcggatcatgaggtacagcattcgagaccagcctggccaacatggtgaaaccctgtctctactaaaaatacaaacattaggccaggtgtggtggcatgcacctgtaatcccagttactcgggaagctgagacaggagaatcgaatgaacccggaaggcaggaggttgcagtgagctgagattgcaccattgcactccagcctgggcaaaaagagcgaaactccatctcaaaaaaaaaaaaaaaagaaagaaaaacaaatattagccgaacatcgtggcacgtgcctgtaatcccagctactcaggaagctgaggtaggagaatcgcttgacctcacgaggtggaggttgcagtcagccaagattgtgccactgcactccaacctgggtgacagagcaaggctctgtgtcaacaaaaaaaaaaaaaaaaaagaaaaagagaaaagaaacatgcttatggctgaagagctgagcccaagtctatgtgattctgaataacatgcttttaatttaattaattaattaatttacttatttatttatttgagacagggtctcactctgtctcccaggctgcagtgccattgcaccatcatggcttggctcactgcagccttgacctcctgggctcaagtgatcctcccacctcagcctcccaactacctgggactacaggcacacactgccatgctcaactaatttttttttttgtttttttgcattttttgaggagacggggtcttactatgttgcctaggctggtcttggactcctgcattcaattgaccctcctgccgcgacctcccaaagtactgggattataggctttagccactgtgcccagcctaaaacttttgagaaagaatgcttcttgttgattgtctcccctctctattaccttagtgtctggcatatagtaggtgcttgaaagcacttgtttagtgcctaagccaggggctgacaaccttactgtaaaggcccagatagtggattatttgaggctttgggggccatgtgctctcttgcaaccatgcaaccctgccgttgtagtgcaaaagcagccacagacaatactttatttataaactctgaaattggaatttcatataattgtcatgtaatgacgtattattccttttgtctttttcccactaactatttaaaatgtaagaactagctgggcgcagtggctcatgcctgtaatcccagtactttgggaggccgaggtgggcggatgacctgaggtcaggagttcgagaccagcctggacaacatggtaaagccctgtctctactaaaaatacaaaaattagctgggtgtggtggcaggtgcctgtaattccagctactcaggaggctgaggcagtagaatcgcttgaacctggcaggcagatgttgcagtgagctgagatggtgccactgcactccagcctgggcgacagagcgagactccatctcaaaataataataataataataataataataatataaaatgtaagaaccattctttcttagctttcaggccataggaaaacaggcagctcggatttggccttcaggctgtattttgcagattcctggtctaaataattaccttaattatcacagtagcagatactagcagatactaagaactagtgtatctccaaagtctagtttggtgcccggtacaaacattctttccccaaggtggagtccacttgaccagagtggagagttacagtgctggggaagagttggaagacatcgctgcctgggggtgggggaagggcagagaaatctcttggggtttgttctggggaaactgggaattgtgggagaactgaggaggcgggaaaggggactttaagaatattattgtgggccaggcgtggtggctcacgcctgtaatcccagcactttggaggctgaggcgggcagatcacgaggtcagtagatcgagaccatcctggctaacacagtgaaaccccgtctctactaaaaatacaaaaaagtagccggccatggtggcggatgcctgtagtcccagctactcgggaggctgaggcaggagaatggcgtgaacctgggaggcggagcttgcagtgagctgaggtcgcaccactgcactccagcccgggcgacagcgagactctgtctcaaaaaaaaaaaaaagagtattattgcaggttaggaattggaccttttattacagaggttctcactggggactgaattgtcccatgtgtgtgtgtttgtgtgtgtgtgtgtgtttgtgtgtgtgtgtgtgtgtctgtgtgtgtgtgtgtgtttgtgtgtgtgtgtttgtgtgtgtgtgtgtttgtgtgtgtgtgtgtgtgtgtgtttgtgtgtgtgtgttttaaatctgcagagagcttttggttgccctaatgatagggatgggggagtcattacggtgtggggtagttttttgaatatatatatgtgtagatcccaaattcatatgggttagaagaaccatgattatcagagtctataaccttgttctatttttttttttttttttgaaacagagtctcactctgtcacccaggctggagtgcagtggtgccatctcggctcactgcaacctctgcctccccggttccagcgattctcctgcctcagcctcccgagtagctgggactacaggcgggtactaccacgtccagctaatttttgtatttttagtagagacggagtttcaccctgttggccaggatggtcttgctctcttgatcttgtgatcggcccacctcggcctcccaaagtgctaggattacaggtgtgagccaccacgcccggtccaaccttcttctattttatctgcctattctattttatatgtttacatgttctattttacatgtaagtgttgaatgaacactgatgtttccaagaatgtagcagctatggtgtaaatcaagagaagatttgactctgtttggtatgggaatttatcaagaaagagccactcttttgaagaacatggcactctcagtaaagccgatgcgacaacacaccacgctgtctgcgtttgtgactgtcactggttattctacacacacgtgtgtgagcacttgactgcttcgctccgtctttcctggtggaaacccaaatcatttctctatatattatttcattagaaatcctcatcatttcatttctcctttttattataattagggcacaattgtgattggttagaagagtagatgggttataggatcagcacattttttttttttcagggtagaaaagagagcttttcagctgggcatggtggctcacgcctataatcccagcactttgggaggctgaggctggtggatcatttgaggtcaggagttcgagaccagcctggccaacatggtgaaaccctgtctctaccaaaaatacaaaaaaaacaatgtaccgggcatggtggcacgcatctgtaatcccagctactcgggaggctgaggcacgagaatcgcttgaactcaggaggtggaggttgcaatgagccaagatcccaccactgccctccagcctggactatagagtgagaccctgtctcaaaaaaaaaagagggcttttcaattggttggttaaaacatgggacattggatctgatggcaccaagaatgcctgccctgtaacactgtttgagctgatgtgtggggaactgcttttggattacttatgggttgctgaaatatacttctttgaatgcagagattgggcccctgattatatttgggaggcaaaaccatcaccttgtaggcacctggcagggtaaaataaatggatgcttcttagaggccaactgctctctcacttcctgtttccgttttgtttgcagcgtaaagccagatgccttttatctcttgtatcagtgctggttgtctgagaatttttttttttttttttggacagagtctcgctctgtcacccaggctggagtgcagtggcgcagtcttggctcaccgcaacctctgcctcttgggttcaagtgattctcctgcctcagcctcccaagtagctgggattacaggtgtccaccaccatgttcagctaatttttgtgtttttagtagagatgggatttcaccatgttggcctggctggtctcaaactcccgacctcaggtgattcacctgtcttggcctcccaaagagctgggattacaggtgtgcaccaccacacccagctaatttttgtatttttagtagagatgaggtttcaccatgttgtccaggctggtcttgaactcctgatctcaaatgatctgcctgcctcagcttcccaaagtgctgagattacaggcatgagccaccatgcctggcctgggcagagtttttaaaaatgcttcaaactctcctttagctcagtttcggtagagtcattcctttacagtatagttacagtggagctgccaatcagctcaggccacacccagcccacagtctcagaggggctgggtccctgctctttctctctccctgaaaagtggctgttaattttctcctttagtctcctttccccagaaagatatttccctttaccttatgggagtttgataaaactggcatctccagccttcttttccttatgttggtttttctgccacaaaaggcccagagacattgtctatggaacgtttggctgcagctgggcaggtgttttattctattggaaaattccactaggattttctatgattacaatagagcatgggtcctcagtcaaaccctccaccacttataagaagctctgtgactttggggaagtgacttaacctctctgagcctcactttttctatttggaaagagtgatgggttggtaggttttatgtgttaactcttagggatacagggtgcacagctatttgcctaaacatcattttgggtgtgttcgtgagggcgttttgggatgactgtcatttaaattggcagattgagggaagcagttgcccctcctaatgtgggtggacttcatccaatccacggaagacctgaatagagcaaaagtcggtcctttccgaagtaagagagaattcctcctgcctgaaggtttttaaactgcaccattggcttttttctgcctttgtactcagactgaaacactgctctttccgggtttcgagcctgctggccttaggactggaactaacaccatcagttctctggggtctccagtttgctgcctcgccctgcagatgacagcacttgttagcctccataattgcgtgaaatctctttctctgtttagacattggttctgtttctctggaaaaccccagtcaatacaggcggtgatcatattttgaggattaaatgatacaatgaatagaatatgcttaacacacagtgagtgcttggcacatatgatctcctcaatacacatcagctttatcatggaaattattatgtatcattatacaaaatataataagatttcaaacttgtgttctcttacatgtcctctaaattattcaatggaacaaaaaactcttcactcatttttgtgtgtatgcaaacttaatgtctttcaataaattttccaagttattgtatgttcgcaaggacataattctgtttgacttcccatctttccaatactagtagtgagcctcattagcacatgaatgctggtgtctgtgagatgtgcttgccttcactgtcctgtttgccttgcccaaggtgggcgatggaaaggacaagccatctattattggttggaggaaggaccaaccatctactgtggcagtctgctcaggctgccatacaaaataccacatactacgtggcttaaacaggagacatttattgttcactattctgggggctgggaattcgaagatcaaggtgctgggtgatttgtttctccagtgagggccctctttgtggctttcagttggaagccttcttgttgtatcctcacaggggagagagagagcacgcaagcatgagagagtgcaagagagagagggagagatcaagcaagagtgagagacagagaaagacatctctggtgtctcttctaatatggacacatcacatctccaggaccttaggcttatgatctcatctaaacataatcaccaaagccgcatcttcaaatacccaaataccgtaacactggtaattagggtgtcagcttcgacatatcagtttgggggtggaggcacaaacgttcatttcatagcacttccttttccaaaaatgctccttaatccctccctgccatccttgctattctcatttgacagatgaggaaattaagactccacgatgtgccttaggttgcccatagctgtacatcttataagtgcgagctccccagataattgcattcatccacaagagcagagttaaccacagcatcatagccatccagggagcataatgccccgttaaaaataacaaagcgtagagacccagcctgaactgaagatgtgtctgtggttggggttcagggttctttgatttccagatctaccacccagatatttgtcaagttacatctacctctggtgctcatttccatatctctaaaacagaaataataactgagaggattttgtggcgtcatgcagatgaagtggctctcaagagcctgacttagtaaacgttggctgcgtgttgggcattattagctaagatgtataaacagcagaggtttggtttgtatgagtagatcatattcctgcctgttgtcactgagggagagcagagtcctaaggggaggggacacaggtcaggagaattctagggggtgggggatgtttctgatttctcaacaatgggtaaatctgggaatctcatgagagcttcagtgggtaaatcttggaatctcgtgagcaaaatgtggacgtgaagaaggaagaaaagctgcttggaggattggtgaaggaggagggaaagggaaaaataaaaggaaaaaaacatttaggtggtgctaagtgccacacattttccgtttttgcatcagtgaattgtaaaatcacactgcaaggctggggatattatccccattttacagatgagagagaggaggctgggcaagttaatgaactggttcaaagtatcacagctagagagttggagccaaagtgagatcgcacagctacgcagactctaaagcccttgtctgtatattgaatcaaatttcccctttttctggcttaggtaaactgaggcaggaagtgatgagaaagggttaagagacgtcggctgctccttaaacatctcccttcccagtgtcatttgccatccataaactctttcaaaatgtgataatggttttgattttcctgtcatctcgatttgatatgagaaatttgggatttccaaattgacagaaaactcgattttaaagatgctggaaggcaaacatctgtgaaaaatcacaggaataatgtcaacatctgtccctgtgaaaggaaattgctgaggttctcaatttacagccaatcaatcaatcttggaggccagggtgcttgcaaattgaaatgcatgttgaagctatagggatggctaattaatttagtttgtatgcctataagatttttcattgtttccagttaaaaaaaaattctcttttgaatagaaaacgtgtgcatatggtaaaaaaaaaaaaaaaattaaacagtaccagaaaaagtatacagtgaaaattaagtttgttttccatcccaaccaccagttcttcttctccaaggtcacaagtgttgctggcttctcttgaaagtttccagagatacaatctttatatagaaaaacatatgtatatatgtctcctcccggttttataaatgatagcccattgtacatattacactgcatcttgacttcattcaacaatatatctttgaggtttttgcatagcagtccatatagacattccttattctttttatcagctgtgtagtattccagtatacggatgtgtataaattaatcagttccctcatggtggacattcaggatattttctgtcattctccacaatttatgctagtatgtccatcttggtgtgtgttcatcagtaggatacaaatctagaggtgagcctcctgggcagatgggatgtgcatttaaagtatgatgccttcatgtaaagggaaggttttcttttcttttttcttattttattaagagacgggggtctcacgatgttgcccaggctggtcttgaactcctgggctctagcaatcctcctgcctcagccttccaaaatgctgggattacagacgtgggccaccgtgcctggccaggttttctttgttatcttggagggagcatcacccccgtcaaggagatcagattggtgaaggtgggatgctgtgtctgagagcttaatgactgttcacagatattgtggctgcccttctctaatgtacctgcttcttcaggcccaaaaggtggaaatgatgtttgtttcttacttctttggggctttgactgtgccattgagattttgtgctcagggataaactaccgtgtatttacagttacctcaacctgtgaggtttgatgcctctttctttctttctttctttctttctttctttctttctttctttctttctttctttctttctttctttttctttctgtctctttctttctttctttctttctttctttctttctttctttctttctttcttccttccttcctttctttctttcttctttcttttttccttcttctttctctttctttcctctttctctctctctttccctccctcccttccttccttcctccatccctcccttcctttcttgctttttttttttcttgctttgttacccaggctggagtgcagtggcatgatcatagctcactgcagccttgaacttctgggctcaagcaatcttcctgccttggccaccctgggattacaggtgtgaaccgtggcgcccagccttggccactttctttattctaaacttctttgttccatactttgcttcttttccctggatccatccccaccagcctcccttgtcactccagtgataggacactcagtcttgccaagtcaatgtaaacccagacccttctcatttaaaacctagtctctttggtaaacagtcaattcaggattctcacatcaatctgagttttaaatcttaattagttgaaagattttcatatctttatctttccactttggtcactggcttcgctgtgggtgctgcaccactcagacctctgtgcaggaccaccgaggccctctgtccccccagctgctgggagacctggctgctaacagctcatagcaaagtcctgcctctggcaagaaggcacctgtaggaagccacctagtgctgggaaatcctcctcccctcctaggcatcccataatcctggagggttacaaaggctctgtcccttgcccctctgtatgggagtgtattagtcagcgttctctagagggacagaactaatagtatagatgtatataaaaagcagagtttattaaggagtattgactcacacgatcaccaggtgaggtctcacaataggccatctccaagctgaggagcaaggaagccagtccaaatcccaaagcctcaaaagtagggacgctaacagtgcagccttcagtctgtggtcaaaggtccaagagtcccaaagctgaagaactcagagtccgacgttcgagggcaggaagcatccagcacgagagaaagatgaaggctggaagactcagccagtcaagcccttccatgctgctctgcctgcttatattctagctatgctggcagctgattagatggtgcccacccagattgagggtgggtctgcttttcctagtccactgactcaaatattaatcttttttggcaacaccctcacagacacatccagaaacaatactttgtatccttcaatccaattaagttgacactcagtattaaccatcacagggggtgtctcaggggtcctggcgactgttccacagtgccactcccctctctgcccaatgctgcttccttgctttccagcaggtgctcctcccagtaaaccccctgcacccagatctccatcccacagcttgtctctctagaaacctgacctatgacaggcttataaacaccacaacagggcatgggtatgggccaggagagctactcctctcatctgctgagggtcctaccccaggacccctggggagggatgaggtccctgttgttcatctgggtgatcatctaactcctgatgagcccaggagttagagaccggcctgggcaacgaagtgagaccccatctctccaaaaaaaaaaaaaaaagtcaaaaaattagccagatgtggtgcatgcccccagctacttgggaggctgagatgggaggatagcattagcccgggaggttgaggctgcagtgagctatgattgcaccactgctcttcatcctgggtggcagactgagaccctgtctcaaaaaagttgtcatggtcctatgacatttttttaggtcctatgcaggggtgcaggtggaggtggtttctggttctacctgactgtcttcgttcagcctggtccatttgttgactctgctacccagaagtgaaagaatatggcatctttctcatctctatatggtccccatgcagtaaggagttgactcagccggtctggggagttcaaatcctgcacattccaaagaaagctctggccgttgattggctcctgggagataaccgccaagtctttggaacattctgcctgataagagtgtctttgtttacctatggcctcaggctgagctagctagtccatgctaacaatgcaatttatggtgagtgcctgtttttgtatgtgtcagtttgacctctagaggggctggagactgagtaacaaaagtcacccatgcaggtgctccatgcctgggtgatgaaatgctgataaaacccctggacaccaaggcttgggggagctgctgtggctggcagtactttgtatacattgctaattgtctcttatagcttggctgtgtccccacccaaatctcatcttgaattgtagcccccacaattcctacgtgttgtgagagggacccagtgggaagtaattgaatcacaggagtggtttcccccatactgttttcatggcagtgaataagtctcacaagatctgatggttttataaggagaacccctttcacttggctctcattctctctttgccagccgccatgtaagacatccctttgctctcccttgctcttctgccatgattgtgaggcctccctagacacgtggaactgcgagtccattaaacctctttttttttttcataaattacccagtctcgggtgtgtctttatcagcagcatgaaaacagactaatacagagcattaggagctatccttctaactccactgggagaaaactactggaaacttacccctggtctctcttggagagacctatgcatcttgtaccttggttgattttaatctgtatccttttagtgcaataaacaatgttcatggggacaatggctttcctgattctgtgggtccttctggcaaatcaatgggcctgagggtggtcttggagatccctgacaaaagtcactgtagccagggaccatcttctgttgagcttatttcagaggaagatgtcataggtaacgggcgttgggggcaccctggttccatttgttgactctgctacccagaagtgaaagaatgtcgcatctttctcatctctgtatggtcccctgcagtaaagagttgactcaggaggtctggggagttcaaatcctgcacattcctaagaaaggtctggcccttcactggctcctggaagataaccactaagtctttgcagcattgtgcctgataagggtgtctttatttgcctttgttctagttcttgttctaggtgctggtgatagaactgtgaaccaaaggtcattgccttcaaggagtttatattcaagtggagaagatggaaaaccctcccctcacaaacaaacagactctgaaacctgataaataaatattagcattcagtgaagtgttaatgagtttctgtgagcacatacaatccttagcagagtttatctcatcctgcctgagctagcccctgcctccctccccagcccacatattttgccacacccttttcattcctcccaacattccaattccttcaacacatggaactccttctcaccccagggcctttgcacatgttactatctctgtataaatgcattcctctcacttgacacctggataactcctcattgtcctagtcttagcttaaatgtcatcatctggccaggcctgatggctgacacctgtaatcccagcactttgggaggcggaggtgggaggttcgcttgagcccaggagttacagaccagcctgggcaatgaagtgagaccccatctctaccaaaagaaaaaaaaaatcaaaaaattagctgcatgtggtgctgcatgcctgtagtcccagctacttaggatgttgaggtgggaggatcatgtgagcctggaaggtcgaggctgcagtgaactgtaattgcaccattgcacctcatcctgggtgacagagtgagactgtctcaaaaaaaaaaaaaattcatgaccttggggaagcccagttggatactctcctctttccccagaccagctggatctaccatcataggctgttatagcatgcatccaattctctctctctttctctcgctccttttttttttttttttttgtagagatgcagtctcactatattgccagggctggtcttgaattcctgggctcaagcaatcctcccacctcggcctcctaaagtgctgggattacaggtgtgagccaccatgcctggcctgttacctttcatttttatttcagtcatcattctgagtggctgagcatatggatgtgttgattgttgaaataaatcatttaggcaaattgttacgggccccatctaaattcagaatccagccatggatctggtctgtaattcttcccagccacactcttccctgttggagtccgagttctccactctagacctgcagcgggaagctttccagggaccagccagttccaccgcctccagagccacccctcacctgctgacctcttcctatgttagctgcccctctcgctgcctgctgcccttccccgggccagctgatacgagagctggcgataacttgaaatgctccccgcagaagataaatgagaggggaatctcagcaggcattgagctctgtacctaacgactggcagttggggcttctaattttaggcctgggaaggaagctgatttctgtgatgaaggtggccacacgctttatcaagggccaatttagcaaaaatctaaaatgtatatgaagccgtggtaagtctggattttcttggtatttatgctgggaggttacttaatgagcgtttgctgtgtgaccacattgcggtattaatcataggtggcattataattctctaaaataacagccataaggcatcagggcaattgaggcttgtattaagggaatggtccttttttttcttgctgaagttaggcagcatgaggctggtgtgtttttccttaaggcaccaaggcatctgaggttttgcactgggaatccctgggctctctgggccctctgggtccctagggtcttctacttgccaacacagccttgggttctctgcttcctgttggggtgacaggaacacattggtggtctctgatggatataccaggcgctctgcataatttttcttcttgcttccgggggtaactccagccccatcccttgaaggtgaattttatgttatatatatatttttttgcttaggcaagtttgatttgggttatattttcatcataaagaatcatgactattgcaaatcattatatagaaaagtgattttattcttgagcctgagatattcacagtgaaaatgacaacacattatttctgagacacctgctgggggcatccaccactttcccccaacccattctctctattcacctccaaccaattttatccaaaagccagctcagctgactgtacaaccacaagggatttggagttagatggatatggcatttatcagctgaatgatcttgggcataatactcaaaccttctgtgcctctgttttctcatctttaaacggggatagcacagggttggtgtgaggaataaatgagttattattgtcatagtaatatactaacatatagttaaatataattctatctgtcagatgtagacaggggtggagaatgccttggaagtcatttcttcctacagaataagtgatatggttttgctgtgtccccacccaaatctcatcttgaattctagctcccataattcccatgtgtcatgggagggacccagtgggagataattgaatcatgggggcagttcccccatactgttctcatggtagtaaataagtctgataagagctgatggttttataaggggtttccccttctgcttggctctcattctctcttgcctgctgccatgtaagatgtgccttttgtcttccgctatgactgtaaggcttccccagccatgtggaactgtgaatccattaaacctatttttccttataaattactcagtctggggtgtgggggtatgtctttatcagcgtgtgaaaatggtaccataaggaagtaccttaaggttagacaataagtacaataaggaaggaggaccgcaatccagtcttgtctcccagagccttggcacagaaagatggtaaccaatgctttgtcttggaaaatccctcctacctgctggggagacaaaggagcaaatccagcagaagatggaggggaagtgctggttgagttgcttggcaccccttgccttttttcaccctcttcctcagctccctgatcaccatactctccctgtgtcttttggctcctgagatcagttgttgatgaaatgctgggctgcgctcactcccagagtgggaggaaatggatgtgggaaccctcttggggagatgggcagttaccggggcccagagaaccaatgagggctttatcctgcagtcagagttcaacaccagcccttcccagaatcaatcacaccctcctttccactatttcactgtctgccgtgaactaacagacattggttgtgttgccctcagattcataggctgaagtctaacccccaatgtgatggtatcaggaggtgaggcctttggaaagtaatgagatcatgagggtggagccctcatgaataggattagtgcccttgtaagaagagatatgagagagatgatacccgtctctccaccacatgaggacacagtgagaaggcagccatctgcaagccaggagagagtcctcaccagaccctgaccatgccagcaccctgatctcagacttcccagcctccagaactgtgagaaataaattgctgttgtttaagcttcacagtctattataatttgttatagcagctcaagctaactaagacactaccctgacactctatttcagaaatgacaaggtttgggctgggtgtggtggctcattcctgtaatcccagcactttgggaggccaaggtgggtggatcacctgaggccaggagttcaagaccagcctggccaacatggtgaaaccctgtctttactaaaaatataaaaattagcaaggtgtggtggtgcacacctgtaatcccagtactctggaggttgaggcaggagaatcacttgaaccttggagacggaagttgcagtgagccgagatcataccacttgtactccagcctgggtgacagagtgagactgtctcaaaaaaaaaaaaaaaaaaaaaaagatgagatttgacttcacaaactaaaacttttgttcagagagaagaggaaaagggagggtgggggaaaccacccatgctcccaaagatatgagacgtagaattgatctaagtgccacaaagcagaatttttctgactccattctgtttctcctgtgataattcagctgctttcaaattcctctcctctcagacggtcctgagaatccagtgggagttttctctgtgctccagaacatagtggcctcttgcattcattccctaccagaaataatgtctcattcaccagctattttctcagccaataatttttgtccacccccattcctccttcagaaacttgcccttcccagagccctaggagacccagaaccccataggattcttttggctctggccatggctgtgtaccaaggggttggatatgggattacagccaggccatgtggactctctcccagaaatttggagttgaaaatctctgagcttatctctggaaggtgcttgaaactagagggggatagaaagttggtgacaatatagtcatgtttggcctgtggacaattgcaatagaaaaaactgatatgcagggtgatatggtttggctgtgtccccacctaaatctcaaattgtagctcccataatttccacatgtcatcggagggacatggtgggaggtaattgaatcgtggggcgggtttttcccatgctgttctcgtgatagtgaataggtctcacgagatctgatggctttaaaaaggggagttcccctgcacacactctcttgcctgccaccatgtaagacatgactttgctcctcattcgtcttctgccataattgtgagatctccaaagccatgtggaactgggagtccgtgaccactctttttctttataaattactcagtcttgggtatgtctttattagcattgtgaaaacagactaatacatgggggggcggagagagagagagggagagagggagatggggagcgagaagatgggggagagagagtgagagagagagacagagagaaagaaagaagagattgagaacacaatacagacttaggaaggacagaccgggagctcccagaaagacagagacaggctgtgttgactcctgctatctttctatcccaaaaccctgctgtgctttctgactttggttttgtgggatgctttatttaataggttgaactgtgttctccaaagagatatgttgaaagccctaacatctcagtaccccagaatgtgacctctgttggaaacagggtcattgcagatgtaattacgaagatgtgatactggagtagggtgggcccttaatctaatacgagattgtccttagaagaagtaggaaatttggacacagacccacagggaagacccccttgtgacaatggggatagcgattgaagttccattttaatgtacgtgctgccgaagcgagcacaaggtagagattgaagtgaagctgctacaagcccaggaatgcctatggttaccagaagccaggaaaggaaaggatgggatcttccccagaggctcggggtacagctttgtgaaccccttgattttggacttcttccctcaagaattgtgagagaataaatttctcttgtttcaagccacctcgtttgtgctgttttgttaatcatccttaggaaatcaatatgccccttatccttcttgaatgagctctgtaccttataatgagattattgcagtctaaaaatctagaactagttgcaggaacatcacagacaagggaaagtttgaaccacaccatggatgagtgacaagcttggaaaagaagggcacttcacctctgtggtattctttgcaaaaactcatgacctgagtctaatcatgaaaaaagaaaaaaatcagacaaactcaaatggaggctaatacggtttggctctgtgttccaaatctcatcttgtggctcccataattcccacgtgttgtgggagggacctggtgggagatgattgaatcatggggacaggtttttcccgtgctgttctcgtgatagtgaattagtcttatgagatctgatggtttttaaaaatgggaatttccctgcacaagctctttttgcctgctgccatccacatcagatgtgacttgctcctccttgccttccaccatatttgtgaggcctccacagccacgtggaactgtaagtccaataaacctgttcttttgtaaattgcccagtctcaggtatgtctttatcagcagcatgaaaatggactaatacagagatatatcctgcaaaatccgtccccagtactcctgaaaactgccaagctctgtagagttagagttagaataccttttgttgttgaagatgtgagggaagtatgcatgtgaattgactgctgaattcactttttttttttttgagacggagtctcgctctgtcgcccaggctggagtgcagtggcgggatctcggcgcactgcaagctccgcctccccggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctgaattcacttttgtgccatttttgtaaatacaatagttttgtacaaccttagaaaaataaggaaaggctgaagaagctacacatttggttggtgtggtttctaatgtagttttattttacattaaaaggtttagacaatgggtcctcatggcagttgctggtgacttaccttgtagttgtaaagctgggttcttgttttctttttcttttaaatgaaattataataataataataataataataataattattattattattattattattattttgagacagcctcttgttctgttacccgggctggagtgcagtggtaagtcgtagctcactgcagcctttaactcctagattcaagggatcatcccatctcagcctgccaagtagctgggaccacaggcagatgccttcacgcctggctaatttttaaattgttggtagagatgaggtttctgtatgttgcccaggctggtctctaactcctgtgctcaatcgatcctcctgcctcagcctcccaaattgctgggatgataggtgtgagccactgcacctggctgaggccttgttttcttgctggctgtcagctggggacctctatcagcttctagaggccacctgcattctttgacatggccctgtcacaacatggtagcttacttcctcctagccagcaagggagtccctaagtctcctaaggggaaatcttatttggtgaaatatgatcaagggagtgacatttggcacctttgccatattctgttgattagaagcaggtcacaagttccatcctctctcaggcggggaggcttgtacaagggagtcaccttagctgtgtgcaatcaggaatacagcccaggggccgtgcctgacagttaagaggactcagtgtgatcaagctgatcaatatgaagtgggttaggcagctgccagtgctaaattctgtttgggagttttccaagaaccagccctacccatgagtatctctctgggtaaacctcctgcaacttgggagtcaccttagctgtgagaaccgtttttcgatcttaccagcaaaaatgacagcccagggtattccaggcagctgcttctccagctccaggcagatgattttggccctgccttgcaacagaaatggaatcgtttcgaggggatggtctcctcgctctggatccagcagcagcagatgctccagccgaagacgtgtgtccactctgagcaaggttgagagaatcaaattaatttcttttatgacccgaggcaagcttgaaattggctcttccaagatgaaaaaggagaggcaggagtggcttgcctggctccctactctccttctcctcctgcctccacctccttcccagcagggctccagcaatttaatcggggtgggattccttccaccaagcaaggcagtctgtcacgcgccgctgcagtaggggccatgccagagacagcttttcgaagcggcatctgtgggcagacatttgggcaaccccactaggctggcaagccctggtcgatttttagtgacctcttagaagtagatgggagggactgtcagccatgccggaagtgggagagagcagaaggggtcaaagacaagcctcggctgggaagagcatctctgtggtcctgtaattgatgattggggtggggagcattgaaacgtttcccttgaatcacagccttcagtgagaatggctttgcctgctgtttggacggtgtgttgagagtagggtaaccatatgtcctcatttgctgcaacagtccctgttacgactgctttcctggttttgcctgtctcgaaagcattctggtttgggcgataacttataaggtcatcctaattctgggtttcacagtctcagcactgtggacattttgggctagataatcctttgggtgagggttgtcctgtgcactgtaaggtgtgtagcagcatccctaggctctgcccactagatgccagtagcacaaccccctgccccattgtcattgccaaatgtcccctgaggggaggaggaggaatcacccctggatgagaaccatggcccttttttaagggcactgttgaatccttccttctgataccatctgggggtaacttgagtacttggttcatgttctggaaggaaaaactccacatagtgcttctgggttcatttagcccatgtaagcttcgtttttctgtttcttagaccagtatctcactttttgcagggagaggtgggacctctcctccattctcagcccatgtgttttgggtgactcgagagactgggtttggcagatgggagaatgccattctcctggctgttgtgattgattcagaaacctgcctttaaggtggttcaaagagcatcagtggcaggacttctgttaggtggatagggaaagaggggttctctttttgctggggttgcaaacctggtagggtggaaaccgggagctgctggtggtcatctcatcaccctgggggagagcctgcctgagaaggaaatcacaggagagccgagctgagagaggagaaggaaagccgatcacactgtctaacagcctgtatcccctccaacctgatgacagatctcacctagagtgaatttctcagtgaagccagtttgacttgagtttctgtcaacttgcaactcaaaaaggccatgtgttgccatgaggtatttctctgttccctttcctaatctagagattaggtaactttaattctgctaatgctgagttttgtctcatcaaatggaaacatcacagaagtctctgatcttgccccatcaacccttcccattacctctagggctcagccaatgctgctggtatcttttgcttcattttttcttttcttttcttttgtttctttctttcttttttttttttctgaggcagggacttgctctgtcacccaggctgaagtgcagtggtgtgatcacggcttactgcagcctcaacctcctgggctcaagtgatcctcccacctcagcctcctgagcataggtgcacaccaccatgcctggctagttttttaaattttgtttgtagagaggggagtcttactcaatcattcaggctggtctcaaactcctgggctccagcaatcctcccaccttgatctcccgaagtgttaggattacaggtgtgagccactgcatctggctgcctcatttttcttaatctttcaagactctgtagaaataatacctactccttttcattcctccttatctcctgtcttcctttccaacactatagccctcttttcattattacccacatttacaaaaggtctttgtaacttaatggcatacccagacagaaataatgttctctgggttaattatctagtttgccacaatctcctgtaccagattctacccagcctgctctgattataaaggggactattgagaaatagctgcaaaaatgcacaaaaccataagaattcccattctaagacccagagcagatggcttttggattattcccttctctttttctatcatatgtttacataattgagttcatcatctatatgaagtcttacatacatatatttttataaagatataaaattatacaatcaccccaattaaaaggcatgaacattattttaataattggaagaagatttcattgtacgaacatagtgtaatttcagaaacatttttctgttggttgacacttcattttttaccatttgcaataatgtgatggcttccttgggcatacatctttgtcctcaactggatgtactcccctaaaataaatttctaggagtggaccttctgggtcaaaatgggtgagtatttgtaaggctcttgatacatattgccaaatgaccttccagaaaaattgtgcctgtttacatgcctaccagtggcatggaagggtcagatgtcagaatcatgattgcaattattgataaagatccagctagttccagttttgccaacaatattaacaccaccagcacatccaccaataataataataacaataatggtatgataaataaaataggtgatatggtttggctgtgtgtctccacccaaatctcatcttgaattataatcaccaggtgtcgcgtcgagggagggagctgtaagccccacgtgtcgaaggagggatgtgattggctcatgggggtggcttctcccatgctggtctcatgatagtgagtgagttctcatgagatctgatggttttaaatgtggcagttttttcccgtgctctcacttctccctcctatcgccttgtgaagatgtctgcttctccttctgtcatgattgtaagtttcctgaggcctccccagccatgcagacctgttgtgagtcaattaaaccccttttctttatcaattacccattcttggccagttgtttatagcagtgtgaggatggactaatacaatagacttattgggagcttgtaatattctagctatgttactaaaaatttcacacattatttcatttagtccatccagtaacctagagattaggtattattataattcccccatttacaaaataggataataaggtacaaagacgttaagcatcttgcctaatgaccacagccagtaaatggtggatcttagatttgatgccaggcatctgacttcttcaagcattgtttactgttttagtatgacggagatgactagttggatgtaattccacctgaatggctagctttactgtgtacagatcaccaaagatctaccttgaggaaaaacattgctatacattgcaaataatagtcagggctctggtattaatgtttcccagtctctccctcctaaggacattgtcaccctcccagacaggtgtgtggtagaaggaaacgactctctcctgatgctatgaattccaaagaattcccattaaccatatttctaagccagtttgctttctttcaatgtgcactttctgcaaaatgccatctgcacttgtttcctggggaaaccatctctctgaggtgggtaagttctcattgtgaagatggggacttgcctaatgtttggcattccctttttggggcacgtacagtgatttctgaactgacttgaaaggccattaacttggtttttactgccttttctggcttgcaaatttaatgcctggctcccaacatgtgtgaatggacaaacagcatcagcatcatctgggaacttgctagaaataaaaattctcaggctttaccctagacttacagaaccagcaactctgagggtaggttccagaagtctgtgagtttacaaatcttccaggtgattctgatccgtgctaaagttggatctactgctctaaaccttagtttcttcctttataaaataatagtagtagtagctgtagcagtaataataatattggcttcatggttatagggggaattccatgagtaatttgagtccttggcactgtgcttggcatacagtaggtgcttaataagtggtagttggcatcactatctctgaactgtgaaggtcgctgtgcttaacctatgtagtatttatcagccccgcatcccactccgttcagggatggcccttctcctgcctgtgggtctggtgggaccactctgcagaatttcttatgcccagatcttctatcatggtgtgacaaaagcatggcccatcaaatgcctgccttctgggaatttgcatcttaaggagagatcatcaaggatgtagagtgattagagtccggtcattccacgaccctgcagcctagtgcttctcaacctttaatctgcttaacgctaactggaggatcttgttcgagggcagattctgactcgaaaggtctggggtggttctgagagagagtctgcatttctgacgagctctactggagatggtgatgccagtactgctggtttctggactcacggtgcagttgcatcccgagagtagtgaatctcatttttcaacctcaccttagaatcacctaggggaggtgtgaaacaagacagacctgagccagttaaatctcagtttctttcctttttgccttgccttgctctgccttgccctgccttgccctgccagggtctcactctgtcatctaggctggagtgcagtggtacaatctcggctcactgcaatctccacctcctgggctcaagctatccttttgcctcagtctcctgagtagctgggactacaggcatgcgccaccacatccagctaatttttgtatttttagtagagacgaggtttcgccatgtttcccaggctggtcttgaactcccgggctcaagtgatctgcctgccttggcctcccacagtgttggaattacaggcataagccaccatgcccggcttaaatctcaatttctgagggtgagggcccagcatcagtggtttctaaaagtctctttggttgactgttggctgcagtgagggttgagatccaccaccatacaaagatggtccaactggaaccccctcaagtctgggaactctattctttctctgatcctgtaagctccccgctttttaatgtaaagatttggttctgttggctgggcatggtggctcacgcctgtaatcccagcactttgggaggccaaggtgggcagatcacgaggtcaggagtttgagaccagcctggccaatatggtgaaactccgtctctactaaaaatacaaaaattagctgggcatggtggcgtgtgcctgtactcccagctactcaggaggctgagggagaagaatcgcttgaacccaagaggcagagcttgcagtgagccgagatcgtgcactacactccagcctgggcgacagagtgagactttgtctcaaaaaaaaaaaaaaaaaaaaaagatttggttctgttgcttgaaaactaagaaccttaactgatagagcctcagaaatgagaagagagtcaaggtgagtgttcattgcctctgggctctccagctgcagatcctcttgcttctctgtgcttctctttgggatgacaccacagagacattaaaccttttggagggcccgtacagtaatttctgaaccaacttgaaaagccataaacttggtttttcctgccttttctggcttgcaaatttaatgcctggctcccaacatgtgtgaatggacaaataaaagaggaactgtcccttcctctctttgcccccatcaagggccacctgagagactgtatctctttaggatcgcttagctctttcctcagtcccaggtctggattttgcgggtgacagcttcaccagtatgtgacaagccatgccaggtgaccagagtgtgaaccagcctgctcacctgtcaggtggtggtaatgaaaaccgatggacctggtgcggtggctcaacacctgtaatcctaacactttgggagtctgaggtgggaggatcacgaggtcaggagttcaagaccagcctggccaatgtggtgagggcctgaagtagtgggaacagagggtgactgaggcagagtcagccttaaaagatcagtcgctaaaaaggacttcaactgcctgcctttggggagagggatttgatgggagaagggctggggtaagacagctttgttttccatttcaagtcatttgtatcatttgcttgtactgctttgataaagagaaatctgaaattctagaaaaaattagaagtgaaaaaaaattcctttatagccatgagcagaaccgttaacaatagcagccgggtatggtggctcacgcctgtaatctcagcactttgggaggccgaggtgggtggatcacctgaggtcaggagttcaaggccagcctggccaacatggcaaaaccccgtctctactaaaaatacaaaaattgccaggcgtggtggtgggtgcctgtaatgccagctactcaggagactgagtatggagaaacacttgaatccaggaggcggaggttgcagtgagccgagagcgctccattgtactccagcctgggtgacaggagtgaaactctatctctaaacaaacaaacaaaaagcaatagcaatagcaacagtaatgacactaacttatattgatgtgctagattttatccatgtcacctcattcacctttagttctcactacaaccttgggtgacaaacttgtgttggctttagcactttactggatttgacactgagcgttccctatacctggaaccacttcggtcctagataaaccaaagaggatggctggtcaccctactacagccccagaggcagctgctattaaccaatgcatgctgcaggggaggaaactgagaccctgagaacttctgtaactcgcatcatggtcacacagctagttagtggtagaaacaagttacataccgactcggtggtggacacaattaagggtcccacagtcagttagttgtagaaacagttaagagtcacacagctagtcagtggttgacatagttaagggttgtgcagctagtcagtggtagatactgttagttaagggtcacataggtagtcagtggtggacacagttaagggtcacacagttagtgatagatttaagggttacacagctagttagtggtagatacagttagttaagggttacacagctagttagtggtagacacagttaagggtcacacagctagtcaatggtagacagttaaaagacacatggatagtttaagacacatggatagtttagtggtagatacagttagttaagggccacacatctagtcagaggcaggtatatttagttaaaggtcacaaagctagtcagtggtaggtacagctagttaagggtcacaaagctagtcagtggtaggtacagttagttaggggttacacagctagtcagtggcagacagttaagggtcacaagactagtcaatggtagacaattaaaagacacatggatagtttagtggttgatacagttagtgaagggtcacacggctagtcagtggtaggtacagttagttaagggtcacacggctagtcagtggtaggtgtagttagttaagggtcacaccgctagtcagtggtaggtatagttagttaagggtcacacggctagtcagtggtaggtacagttagttaagggtcacacagctagtcagtggtaggtacagttggtgagccatctcatcactcgtttagtagtagagcttggattggaaccaggtagggctgtgtctgttacattacatcacgtcacatggagtctcagagctgaaaggactttagggtcgccgtgtctattccccttgtttgtagatggggaaacttgcctgagtggcggaacgccctacccaaggtcgcatggtgagttttgggcttctaagagaccactggaggaagtcagggagacatgccctggcagggacccgtccggaggcctgccaattggctttgagaggagcgcgtcttgcatctcccaggaaggattggcagagggagggcgggcgtctcgggccgggggctggtgcccggggctggggctgaggggagggggaggctgcttctctttgtaatttacatacacagcagcaacagcctgggggaaaacaacccaaacaaactctcaaaggatgttttggacttaatcccgggatcggaagcagctcggtaagataaataagataaagttggtgtgcctcttaaggttgaacgatcatatcactattgcatttgaaatattcatgaggggaagggaggtatgagaaacagctacagaaacatattctgctttgaaaaggcagaattcaaaggcatgaaaaatgaatcaggggaaattaatgtcgaggttgggaggggggtgggctggtggggggacaattattgcccagaaggaataaggaaagagatgtggaggagatgtttcagactgggccgtgatcagaattctgtatcctgcctggaatatttgaaatgtcaattgtctcatatatcatttgaagtcaatacttggtcgcaaaatggatgattctagcaaggattaaaaagcagggtgggctgggggatatgggatggggagggtggagtggggtggggcagggagatggaaaaagatgggtaaagtgaactaagtcctataaattgtggacgaattactgatcactcaaagagggctctggaggagtaagatgcaaagaaacgggaatttcttgtgatttcttgcaagtctctcggtcttggtttctccctttataaagccaggaggttgggctggatgttctcctagatggtcccactttgccttgtggagggggtggggctctgatttggagatgtgcttggaaatagagggttccttaaggcaagagggtcaagggtattgacgaacggtagcaatacagacatgatgcttgtggttaatggtggctctcagcagagccctgcaagtctacaccgtgttaggggggccagtggggtttggccccatttaaaagcaagcccttggactgtggactggcgcggtcattctagagagatctgacactaaagcaaatgaaggctgcatattctctgtggtcccagaccagcagcatcagcatcacctgggagcttgttagaaatggaaattctcgagtctccttccagacttcttgagtcaaaatctgccttttaacaagatccctgggtgagtcctgtgcatattaaagactgagcagcagcaattcccctcctggatttataccccagagaaagtttcacccaaggatgttcaaggaggtgggtttgtggtagcggggtattggaagccactgctgtgcgcatcagaaggggatagataagcaaagcatgacagatactcactgtgggatatgactgtggtagttagaaaaacaggtctgatcttcacatgccagtatggacggatcttttattttatttatttatttatttatttatttattttgagatggagtctcactctgttgcccaggctggggtgcaatggtgcaatcttggctcactgcaacctccgcctcctgggttccagcaattctgcctcagcctcccgagtagctgggattacaggcgcccgccaccatacctggctaatgttgtatttttagtagagacagggtttcaccatactagccaggctggtctcgaactcctgaccacaggtgatcctcccaccgcagcctcccaaagtgctgggattacatgcgtgagccactgtgcctggcctggatggatcttaaaaacaaagcacaaggggaaaaaaagtgagcaatagaatcaatttatagcaagtgtctttgtttgtgctgctataaaggaacacctgaggctggataatttacaaagaaaaaaagtttatttggctcatcattctgcaagaatcatggcaccaacatctgcttctgatgagggcttcaggaagcttccactcatggcagaagtgaagaggaactggtgtgtgtagatcacatggtaagatagagagagaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaagagagagagagagggagataagaggggtatgaggaaggaggatgagagaaggaagaaggagacagggaagaataggagacagaggagggttccaggttatttttaactatcagttctcggccggatgcagtggcttatgcctgtaatcccagcactttgggaggccgaagtgggtggatcacttgaggtcaggagttcgagaccagcctggccaacatgtcgaaaccctctctgtactaaaaatacaaacattagccaggcatggtggctcttgcctgtaactccagctacttgggaggctaaggtgggagaattacttgaacccaggaggtggaggttgcaatgagccgagatcttgccattgcactccagcctggccgacagagcgagactgtgtcccaaaataaataaataaataaataaataaataaataaataaataaataaatagaaaaaaataaaaacacaaaaattagctggatgtagtggcgggtgcctgtaatcccagctacctgggaggctgaggcaggagaatctcttgaatccgggaggcagaggttgcagtgagctgaaatcgtgccactgcactccagtctgggcaacagagtgagattacatcttgaaacacacacacacacgcacacacaatcagttcttgcaggaactaagagtgggaaatcactcactcttgagagaatggcacccagccattcctgagggatctgcccccacgaccaaaacacctcccaccaggccccacctccaacactggggatcacatttcaacatgagacttggcaggggccaaaacaaaccatatctagaccatagtatgacacaatttttattggttaaaaatgtatttgtacacaagacagtatgcttaaagctacaagagggcagggatttctgtctattttgttcaccgttgtcttcttgccacattctgaacactcaatatttgatgagcaaatgcacttcacaagaatgcgcacacattcaagagaagaggaatacctcagctgagggggttttgcactgcaccgtggtgatgccagaaactcaggagtaattcactccactttctgcacctggggtgaaatagaagcccaatcttgtgtgagaggtgagggggagggtggccgggctggcctacgtttgcagagcttgttccatttcacagtggcttggctgccctgcccttggtccctccaaggtcctgcttgctcagctcttggcttgccaccttcctgctccatctctaaggctttattggctgttcctgtagaaacagactctccaagtcatggctttttctcagcattttgcatgtaccacctcccttatcctcacaacactgcctacaacactggttctcaactggggacacttccatccccataagggacatttggcaatgtctggagacatttttgattgtcacaactagggtatactgtgctactgtcatccagtacgtagaggccatggatgctgctaaacatcctacaaggcacagggctgtccccagactccccagtaaagaacgatcaggtccaaaatgtcagtggtgttgaggctgacctagggtagggggctctaatatctctattttatatgtgaggaaacggaagcatggtgaggttgggtaatcctgtgtgaggtcctgcagctggtaggcaatggagatggggtatagaccaagtgagtctggctctagagtccttgcttttaaccaccatacatgattgcttctcagaagtggaaaacgctgagacaggcacagctttttatacctttactcacttatgttacggcgagggtgaccagctgtcttggtttgcccaggcctgagcggattcccagagtgtgggacttgcagtgctcaagccaggatggatagtcaccctagtaacctccagactctgtagacatctgtgtttgtgatctgattgttactttcagtctgttgagttcatattactgatgtaagagttaagaagagattatttaggcagatagtgagggtaaggaagtcctcagtaaggttttccttttaatgaaaagcagtccccaaatcatttttcttttctaacggagagcatcctgtaaaatcaagctgcagacataggcaagcaagctggaagcttgcacgggtgaatgccggcagctccgcccataagaaaaggctagctggggctaggcacgtccaacagggcagctccatcttcccttctctttgccagccatgtgtacagtaaggagcaggcaacaaggagccagccaggcaaagaccccatttgcataataacactagggtggggcggccaacttccccatgcgctatgtaaatgtcacacctggtgcaaccaatctttgggccctagtaaatcaggcaccgcctccccaaccctgtaaaatctggtgcactctgacttgggccagaagtcccactgggtgcccccctctcggaagagagacagtgttctcctttctcattcttttgcctattaaacctctgcttttaaactcactctttgtgtgtgtctgtgtccttaatgtttttggtatgaggcaacgaatctcaggtattacccccgagagaatgatgctgcttcactctgtgctaatcacaattgacacaagggccgaatcccagtctcaagttcacctacgatgactttatcatccacatggctcaaagctgtggtcaagtttcctcctgttttgaaaatatgtgctatgctccagttaagtcagcacagctctaggtagatcaaaattcatctttggaggatttctgaaattcacttgaggagtagatcagttggggatggtgtgatggaggaaaaagaaaatcccaaggtttgatggcaaggttagagtgaccttctgaccttgagcaaatggcttaagctgtctgggccttgatgtcctcgtttataaaatgagtccgtaataaaagccacaatgatgagcatcaggcactgtgctgagtgtttgccatctaaggggttatctggttatctcatttaatcatcacaaccacgggaggggaagctcctggggttaagtgtctcgcccaaggttgcagctggtggggaatagtctggttgcaaacccagagaccacacttttaactgctatggaatgttgtctcccgtggctgtttctgaggagatagaaaaacatgccaattagggccaaaaaaacgggaggtggcctcaagggcagtgcattacattaagagtgtttgcaaaggcgtgggtgtttctccacccccgagtcgctgctgacttcccgacacctacacgcagggtcaccctgcagcttctgagcacctggccggctccccccagcaatgtgtgtttgatgttatcagggggtttgaggcacggctgaggccccaggaatctttctctttcatggagaagccaagctcacatctcccagtggcagctggtgctggcgtctggctggagttgcagggactatgtgtcagctctagcagttcctgcgactgtattcacctactgaaggtccttgatctattgctggggtttgccaagggtctcaggggtctgctgcggagcagagagactgattattattttttaaatctccagttgacccccttgttctcacgttaatcactttgagaataaaaatggctaccaataattgagcacttactacgtgccaggcacaggcacatcctatgcctccctccctcctcctccggggctgctggctctccttatcctttttatttttgcttttttctccacagctagtaactgtgttctaaacaccaataagagggcctggcaaatgtggttactcaataacatttattgaatgaatgggtgtgagcgagtgtgtgttaggctccctgctaagcccattacgtgtattattttactcaactctcacagtaatcctatgagataagcttcatctttatctccatgttacaaaggagaaaatgtgctcagagatgtcaagtaatttcccccaaaatgcacagcttgtgtcaacgcaagaatgcaaatttagcagtctccaaattctaccccatttactatctcccaaatagatatgtataaatatcccacatatggagatacattttaaggatttatacgtatctatttccatgtaacacggccacacatatgtatcctatataatatgcacatgtatagtatgtgcacatattcacgtgtaaatgtatcagttacctgtagctgtgtaacaagtaacaccaccctcatggttataaaaataaacacttattttttgctcataggtctgtggtttagctggagagattctgctttaggctgtgggttgagttcaagtctgattcttacatttatttctgaggtccagattggagaagcagtggtacctggtgaaggttggcagcttccagagaggagtgagcagaaatactcaatgccttttaaggcctaagctgggaactggtgcaccgtcagctctgctcatgttccattggccaaaacaaacccatcactaacagggcagaggattctgttcttcccatggtgaagggaatgagagggaagtaaatatttgttaaacaggaaaacataccactatcatattttaattatatatggatgtatttgtattttatctttttttttgagatggagtttcgcacttgtcacccaggctggagtgcaatggcacgttcacggctcactgcaacctctacctcctgggttcaagcaattctcctgcctcagcctcccgagtagctgggattacaggcacctgccaccatacccagcttttttttttttttttttttttttgtatttttttttttactagagatgaggtttcaccatgttggccaggctggtcttgaactcctgacctcaggtgatccacctgcctctgcctcccaaagtgctgggattacaggcataagcctcggcgcccagcctatatttatctttttcacccatgaccccagcttcagtgaggagttctgttactttgtacttttactgggcattcgtttccttgtttggaaaatagtgactataattaataaaagtgtttgtattcttgcaaattgctaagagagtaaatttgaagcatccccaccacttgttaattagcttgatttcaccagtccgcaatgtatacatatttcaaaacatcaggttgtacacaataattatagacaatttttgtttgtcaattcaaaaagtaataagtaaaggaaaagaaaaatgtaagatactttaaaaaatgactggctcgtgttgagaagtaacttttactatttatttgtttttttgtttgttggttggttggttttttttttttttttttgagacggagtttcgctcttgttgcccaggctggagtgcagtggcacgatcttggcttactgcaatttctgtctcccggggttcaagcaattctcctgtctcagcctcctgagtagctggcattacagatgcccaccaccatacctggctaattttttgtatttttagtagagacagggttttgccactttggccagactggtctcagactcctggcctcaggtgatccacctgccttggcctcccaaagtgctgggattacaggcatgagccaccgtgcccagcctaacttgtactatttatttgagttaagccaacacacacttgagttccccacatgtcatagagtgatgtggacaagcccttgaaatctggctttcctgattacctggttgaccttgtagatgcctctctgagcctcagatatgttctctgtgaaatgggcatgaaaccagtacccactttgtagagcactgtgaggattaagtgagaggatacgtgcaaaagtttaccacagtgcctggctccagaagccactcaatatatatttgctgttgttattaatattgatactattcttacaacaaaaacagcacagatgttctaatgatcaattatcctagcctgtcgtctgctggtccccagcccatgtttctcggaccctgtctgtgtgtgatttatgatccgactctctctacactttgtgttggggtttgatttttcctgctttggctcaagacccccttcctacagaaatgtttggacccatcttacagacttgtgcctccttggctgtcctgcctggtcagccccttggaacacagggttggccctaagttggtcctcccatcccagcaaaatggttcactggggcattgcaggttgattgtggaatttcaacaatagcatgggtggtgggaaaaccttcggacatccacagacagcagcctggatgtataagagatgggggtggtgttctttccatctggagtcctccgggagctgtcaagcctggaatctttgcaatttaggcagtctgtttgtaatggtctcaagaaaacccattctgcctacaaacgcggtgacctttaatttttttttctcagatttttccaagatgcacattgactcttcctgtcaacgtggaaggctctaatgccgcctggggcatttagattgcatttgccaatcgctgactgctgtagccaatttgttcctgatctcaaggtcgattttgaataactttagctgggctaagtctcttgcattgaataactgggaaacaacctattaaggtagcaggcgggcgggggcaggagggggcagggggctgtttctattttgtagaagttctttgattttggataaatgagaaggcttctagctctgccagtcatggactatgtggccttgaacaagggagggaaagaaagaaacacatgccaagtacctagcatatgctagacacagtgctgggcacttcacacatgccagctgcttaatctactccgcgaggtgaacatcgtgatctccatgttacagataaagaaacggagtcccggcaacttgcagggttgagcttggatctgtctaaagccccgcccctccccctttttttgtttgtttgagacggagtcttgctatgttgcccaggctggtgtgcaacagtgcaatgatcttggctcactgcaacctccgcctgccaggttcaagcaattctcctgcctcagcctcccgagcagcttgggattacaggcacgtgccaccatgcccagctaattttttatattttttgtatagacgaggtttcaccatgctggccaggttggtctccaactcctgacctcttgagccgcccgcctcggcctcccaaagtgctgggattacaggcgtgagccaccgcgcccggccgatgatgctctttttaaactatccttatgagtgtatttcagcaacctcccccgacccgaattacagtaccacaggctgcgtcctaatgctgtgccctctcctgatatggtctggctgtatccccatccaaactcaccttgaattgtaataatccccacgtgtcaagggcggggccaggtggagataattaaaacatgggggcagtttccgcatacggttctcatggtagtgagtaagtctcacgagatctgatggttttataaatgggagttccgctgcgcaagctctcttgcctgcccctgtgtagcatgtgacttcgctgttctttggccttccaccatgattgtgagacctcctcagccatgtggaactgtgagtccattcaacctctttcctttgtaaattactcagtctcgggtaggtctttattagcagcgtgagaacaaataaacctcctgtcatcttctctccttggattcactcctctagtctgagatgtctggttcgccttgtttccccagcggtgggctcatgccggcaggggttggcatcagcaactgttctttgatcccatgactctgattttgagatgagcctggtgcagcttggtggtttcacgtggggccctttggaaggagaaaacctggtccgaatccctgcaagttgtgtgacgggttgggttccttggaagcccgagaatgagatttgggtaggtgcggtttattcaaggtgggggttctcaggagaaggaaagtgagggaaggaggatgatgggggaggggacagagccaagcaagaatgggctctcaggctgaggctagccttgatctcacgtgggtctctggagtgtattctgccttgaagcaggaggactggacttttgtgtgactcctctcgcctcatatcgcttagtcattggccagttcagcatgtgagagcataactccctgggtgaaatggcttttgctagctaaggaattctccggagaaagtattggtataagccattaggcacagatcagcaaaggctgaatgatgagtggtttactggcaatgaggatctgggtgaagcaccaggaacagctgcgacgttgtgcaactgctctgcctcagttttcctcatctgtaaaatggggatgttgataaaacccatctctgagcgttgatgcaagggttagatgagatacttgcatttgtgttactgataatgtgcctgtcactggccaggtgcaaagcaagggctcaacgaaagcataagctattattattattattattattgttattactggcagttttggatccatagcaacaagcacatataaacaatgctcacttcttctctagtttaattcttataactcttctgagataagttctacttctaccctgttttacagacatggaaactgaggcacagtgaggtgaagcactttgagctcacatgatggggctgagattccaatttagggagtccagtcccagagcccccaagtgagtgctggtttgggactgtctcttctgatcatgacaaatcttttttttgagatcactctcagttccttgaatgtatccatcttctctgttgtttctgggtctttgtatattctattctctgtgctggcaacagcttttccgctttaacctgatctgccctggttcatcccttgagactgagctctgagctcatatttggccttttttttttttttttgagacaaggtctcaccctgtcacccaggctggagtgcagtggtgcaatcgtgactcactgcagcctcaacctcccaggctcaagtgatcctcccacctcagcctcccgagtagctgggactacaattgcatgctaccatgcccagctaacttgtgtactttttgtagagatgaggtttcgtcatattacccaggctggcctcgaactctcaggatcaagtgatctgcctgcctcaacctcccaaagtgctgggattacaggtatgagccacggcgcttggcccatgtttggccttttccaggaagccctccaggttgcctccttccacagccccttgtctgttccccaaagtgtctgttaggatgtattacacttgcctagtcacttgtctgcctctcccattagtctatggctccaaagaattgaatattttgcctgtctctatcattgtcacccctgcaagtagcatttgtctggcacatagtaggtactcaataaatgtttattttgtggctgaatgagcattccagattcagaactggaaacattggaggcttacaaaagttcagaaccgcatacattggaggcttacaaaagttcctgttgagttgaattaattcattttgaaatgacatggactaagttctttctgggaaggtttcctaactaaatccgtgggcatggtggactggagcgttccagaaccagtgcaaagagtcccctgtccataggcatgagatgaaggctcagggacttaaaatacacttctattgtggaaagttcttcagagacccttctggcattttatttaattgatgctcggctcatttattttattattttatttttattttttaatttttttattttttttttgagacggagtcttgctctgtcactcaggctggagtgcagtggcgcaatctcggctcactgcaacctctgcctcccaggttcaagcaattctctgcctcagcctcccgagtagctgggattataggcaagtgccaccatgcccagctaatttttgtatttttagtagagacggggtttcaccatcttggccaggctggtcttgaactcctgacctcgtgatctgcctgcctcgacctgccaaagtgctggaattacaggcgtgagccacggcgcccagccatttttattttattttttttgagatggaatgtcactctgtcacctaggctggagtacagtggcgcaatctcggctcactgcagcccccacctccccggttcaaacgattctcctgcctcagcctcccaaatagctggaactacaggcacacacccacacaccaccacacctggctaatttttgtatttttggtagagacggggtttcaccatgttgcccaggctagttttgaactcctgacctcaggtgatctgcccaccttggcctctcgaagtgctgggattacaggcatgagccaccacgcctggcccagttaatttattttatgtaatgaatgtatttcttttcattaggaaagtatgagaatcacgttgctgaaaatgtgggaaacctagaaaagtagagaaacccacccactatcatttggtagtaaatttcttcagatttttctcctcccatatatgtttttctctttctttattaaacatacttatgaccatactattaatatagtttagtatcctgctactttttttccgtttagcaaaatgagatttttccaggtttaattacatagttttaaaaataaccatcatcattttgttcttatttttttcccttttgaatttaaaaaaaaaaatcatagtaatatgagcacatcgtacaaagttaaagtacagaggagctgctaatgaaagcagcggttcctggccccttctctcctctctcccctccttaagtcttatttcccggaggtaagtgcttgaaatgttgtttccatttttaggtcttcggttatttatctctgtaactccaaataagatgcttatgtggctgtttcttgatttatcaatttaagacattttctattgactctgtgccatagaagatgaggattcagcttattgacatggttcctccccactttttgtccttccccagtttttatttgaaaaaagtcagacgtgcacatggcaaatgatgaccggaggatgaaggagcctctcttactctaatgcttcagtcttccacccacccctcctcccagtttcttgtgtatctgtggcaggtcaaagatgagtgcaaactgtttgataccccatgcattcagaaatggggtctatttcccttttcctgagcctgggctggcctgtgactgctttgacgaatagattgccatagaagtgacaccatgatggttctggtcctggcatttaagggatcatgcagtttccgccttacacctcttggaactcttggttttaaacccctgagccactgtgtgagaaatctgagggcttttgctggagggaaacctggagagactctgagatgacatggaaagggagagaagttgctctgagcccagcttccatcctgtcccactgatatgatttggctgtgtccccatccaaatctcatcttgaattctcacatgttgtgagagggacccggtgggaggtaattgaatcatgggggtgggtctttctcatgctattctcatgatagtaagtctcatgagatctgatggttttataacagggagtttccctgcacaagctctctttttgcctgctgccatccatgtaagacgtgacttgctcctccttgccttccaccatgattgcgaggctccccagccatgtggaactctgagtccattaaacctctttcctgtaaaaatgacccagtctcaggtatgtctttattaagagcatgaaaatggactaatacacccaccaaggtgcctggcacatcactaaaactgcactagacccttcagagcagccccgaagccctctgaatactactgagtgacctcagatgatactgtgtgagcagaagaactgcccagctgggtcctgcttgaattcctgaccctcaaaatcatgatctataataaaaacagttgtggctttaagccataatgtttggggattaacttgaatggcatccttcaggagataccccatgtgtcataggttttggggatggaggttatcttagcctaccaacagtgcctgatacaaatatgtgaatgtttcattgggtcacgcaatctcaagaaagcagggataagggaaagagagaaagaggaagagcaaaaccaaagaagtgcatattgcctagtggagttgcagtttcccagaaacacaagcatgggataactctggagtcagtcatctgccagctcctgctgtttcctgtctcttattggtcaaagcttgctccactctgcacttctgagtaatggccctcagcccctcctagcagcttctgggggatccaggacctctgggagctgataggtgtgatagaggccagcccttaaccccacccagggtaggctgagtcacttttattttattgtaaaattgatatttatttacttattattttaaggtaattttttttgagacaggatcgtgctctgttgcccaggctggagtacagtggcacagtcatagctcactgcaacctcaaactactgggctcatgtgatcctcctgcctcagcctcctgagtagctgggactacaggtatgcaccaccatgcatggctagtttttaaaaagtttttttggagggatggggttttgctttgtttcccaggctagtctcaaactcttgacctcaagagatcctcctgcttcagcctctcaaattgctgagattacaggcataagccactatgcctggcctctattattattattttgagacagagtctcactctgttgcccaggctggagtacatcggtgcagtcttggctcactgcaacctctgcctcctgggttcaaacaattcttgtgcctcagcctccgagtagctgggactacaggtgtgtgccatcatgactggctaatttttgtgtttttagtagagatggggtttcgccatgttggccaggttggtcttgaactcctgacctcaagtatccacctgcctcggcctcccgaagtgctaggataacaggtgtcggtcacagctcctggccactggcttctatttttttattttttgagagggagtctagctcttgttgcccaggctggggttcagtggcgcaatctcggctcactgcaacctctcaagttcaagagattctccagcctcagcctcccgagtagctgggattacaggcacgcgccgccacgcccagctaatttttgtattttcagtagagacaggtttcaccatgttggcaggatggtctcgatctcctgacctcatgatccacccaccttggcctcccaaagtgctgggattacaggcgtgggccatggcacctggcccagcctctatttttaaagtaacttttatgggatgtcagacattgtaaattttaccttggtgggtgctggatgtttttgtgcctggcacagtcctaggtgctgaggacctagcattgaacaaaaacaaagatccctgctcttgctgaacttccatgctactgtggggagacaatcagtgaacaacaagcataatttaggtttgctcttattatactgttgcacacgtaccttttgtatatgtactcttaaacggccattgtttttagtgatttgattgaacaaatatatttgattgaacagatatatccttgctgaatgagccatttctctattgatgggtaattatattactttctctagtaagagtcatcagaagcttagaggcttaagaatctaagctcaacaaacagaggttggagaggttattataaagtccattgtgagagcagccactcctaaccttgggaccaaagattggtattgcgtgacctgtgagccagaattaccctggattggactgtcctaccaggtgggcccctggccagcaaaagagatgatgggggttgttagaatgtcagagagggccttagacaccccttttccatatagtctccagctctttgactaaaacctgtaccccagtatataatcagtcacccaggcctagagtcaaggtcttttatatcatgtaaatttattttttatttttaaaattttttatttccatagggttttggggaacaggtggtatttggttatgtgagtaagttctttaatagtgatttgtgagattttggtgcagccattatctgagcagtacacactgaacccaatttgtagtcttttatccctcaccccctcccaccctttcccccgagtccccagagtccattgtatcattcttatgcctttgcatcctcatagcttagctcccacttgtgagtgagaacatacgacgtttggttttccattcctgagttacttcacctagaataataatctccagttccatccaggttgctgtgaatgccattaattcattccttattatggctgagtagtataaatatactgctggtatatggcatatatataccacagtttctttatccactcgttgattgataggcatttgagctggtttcatatttttgcagttgtgaattgtgctgctataaacatgcatgtgcaagtatctttctcatataatgatttcttttcctcagggtagatacccagtagtgggattgccagatcaaatggtggtgctacttttctttaaggaatctccacactgtcttccaaggtggttgtactagtttacattcccgccagcagtgtagaagtgttcccttttcaccacctccatgccaacatctattatgttttgattttttgattctggtcattcttgcaggagtaaggcggtatcgcattgtggttttgatttgcgtttccctgatcattagtgatgttgagcattttttcacatgtttgttggccatttgtttatcttcttttgaaaattgtctattcatgtggatttataccttccccgtattcccatgcctttgtcttcaatgggactattattttttgtctaatggctttgaattaaatcttctgtcttctattccactgatctccagtctccagcaataattatgctgtttgcattggggaaggtggcagatgtagttgttgccttgcctatgtcctctggcataggaactcaccattcctactgcaagcatctgcaatactgcctggggctttgtctcactgccataacctaggctcttgtggggcaggctggaagtgcagagaaaccaacacaggcacatctcccccagccagctgctgagggcagttgccctgccttccataccttagggtgaggcaggcgctatgctgtctcccagatgtccccagtgggattgaaccccagttgcccatagtagcagcctgcttataaacatgacctggattagctcctttcccttctctgtctcatttccctattgtcatcccagtgtttcctgggctcactttccaaatcaacccacttatcttcaagtccttctgtattagtctgttctcatgctgctaataaagacatgcctgagactgggtcatttataaaggaaagaggtttaatggactcacagttctgcatggctggaaaggcctcacaatcatggtggaagacaagaaggagcaaagccacatcttacacggcagcaggcaagaggcttgtgcaggggaactcccatttataaaaccatcagatctcatgagacttactatcaggagaacagtatgggggaaaccacccccatgattcaattatctccacctgcccccgcccttgacacatggagattgttacaattcaaggtgagatctgggtagggacgcagccaaaccatctcaccttctcttaggatttgtttctggggaaacctaacctatctaagatgatgaaaaatacaaagaaccaggaaaatccataaatagatttaacaagaaaattttacctagtcttgatgagtggcaaagcttgactgccctgaggaagtgactttgctgagctgagacctgaggatgggtaggagttagctaagcaaagcagcactggaagaacagcaggggaagaacattccaagcatagggaagagcatgtgcgaaggtcctggggcaggaatgctagtgtggatggggtgcagaaagagaggcagagaatggtggttatctttggaggatatatggcctgaaagtgaatttgggtccctgactttaagtctctttcctctgcagtttaattatgtctatacacttttttttgaaccccattatggtctggcttcatttaaatgcatctgaaatgaaatctctaatgttaacagtgttgtcagatgtgaaggcttcatttctctttggttctttttcaccgaatgctatctgtgagtttctggggaggatatgaggattttgattgttttgatttttttttttttttgtatgaccacattatgttaatttccccattgtcttagagtatgagaacataaaagcaataactcatttatatgaagactgaatgtgctgagaggttgtcatggaaacctctcatgttggcttgagtaaattgaataacccctgttaaaagactgaacacagataactggcaggctttgtttcagggcaagagttcacaaactggggtccacagatgctcaaacattctatcatgaatagaattcggggatcccatgatcttggacagttaaaaatacatcttatattcttttatctctacctgaagtttagtctttctttccattgtgaatgaataaagcaataaacaaacaaaaaaacaaaagattgaacacagaacttatttacccaattgcatggcattcacaagagatgagaaattcaacatgatacatgagatttttcccccccgcaggggcagggaggaggatgaagagggtgaatgaatgctaggaatgtattatttttatttagacagtgatttctatttttctttcaaagattatatttttgtttccaaatgggagaggtgttatggggcgatagagaaaggatccagggaaaattgcatggtaaaattgctcctgggaaagaccagcttagggtatccatgattgtcgcttctgtagccctgagcatgtttctccccttggagcatcctctgaagtcttggtcagagtcgttgaagagacatgaaccttttcagcattttctgctttgctttggcaggattgtttactgcctatcaagctgacttacaaaaaatactagttctgttgtttttcatttttaaaagcaaattgcttcacctcttcgtaaataactccttaaaagaaaagccgtggatgacagatgaggaagcatagttgggaacagagcgcggcactcgctcacgatcatagtgtcaggtcacaggaagccctctgagccccgggggtgggggcagcctctttaaagtgattatggagcaagaggagcttgaacagtggcactctgagcgttgtcttgggccagcttggagatcaggtcctgggctccagaagacatcgaggctggttctacctggatgttgcatccgtaggtatcaaagtaggagatgctttcgaggggtgagtttttcatcagtggcctccaccccaaagcaccatagtcctacctccttgttgtatgtctttcttctcacaggctgcttgtcagacttcagaatttcatgggcatgatgggcaaataagcttgattaatgcttcatgcttgctatccactaaatgtgttcccaccatgtgttgaaacctaatccccagtgtgatggatggtattagggggtggggcctttgggaggtgattaggacatgatggtggggactccacaagtgggattcatgcctatttatttatttatttgagacaagagtctcaccctgttcccaggctagagtgcagtagtaccatctaggctcactgcaacctctgcctctgggtttaagtgattctcctgcctcatcctctgagtagctgagactactggataattatctaccacacctggataattttttttttttttgtatttttagagagatgaggttccaccacgttggccaggctgtcttgaactcctgatccaagtgatctgcccatcttggcctcccaaagtgctaggtttacaggcgtgagccactgcgcctggccaatgcccttttaaaaggggtcccagagagcccctttgcccttccatgatgggaagacacagtgaaaagagggctgtctatgaactaggaagaaggccttccccagacactgaatctgcctgggacttcccagatcttctggagagaaccgtgagaaataaatgtctgctgtttgtaagccacacaacctatggcattctcttatagcagtctaaatagactaagataataccataaggatctacctttgggactgtgtgctgttataataaaggctctgataagtcctgctagcgccgtttagaccaggggtttctaaactttttgaccacacaagttatttttccctttgcaagcaccttccatggaaatcttttgggaggctgaggcatgagaattgcttgaacccatgaagtgaaggttgcagtgaactgagatcatgccactgcactccagcctgggtgatggagtgagactctgtgtcaaaaaaaaaaaaaaaaaaaaagaaaagaaagaaaaaagaaaatattttcaaaatgatgccatggattaaatctgatagtcacaaaggatccttgtctggtgttacctccatttgatgggtgaggaaacaggagtcctgagaaaccaagtaacttgctcagggtcatgctgttaggatgtagcagaatcagaaccaaaaccctaagtcccagacgactaaaatccaccactccaatggagaggcccttactgcaatgacctgttctgaaggagcgaaacaaggcatttattgcagcatcatttaattaggaaaaaaatctggaaagaccctgaatgtccaactaaagggaaatagttgatatttatgatacttccatacaatagaatgttatggggcatcgataatagacatgaagcacagtaacatgaggtggcacatattataatgtaaaatggagaaataaagcaaaatgataatcatgcaaattaaatgcatgaaactaaaaaagaaatacaaaatagtagctgtctctagatggtaggtgagtcagttcaggtcctctgagtagcagaaggcaaaacagaattaattgtacaaggtcccagtctccactgatttcaaatccacttttcaacttctgtatgaagttctcattctcttactaatttttttttttttttgaggcggagtctcactctgttgccaggcttgagtgtagtggcgcgatctcggctcaccgtaacctgcgcctcccgggttcaagtgatttcctgcctcagcctcccaggtagctgggattacaggcgcatgccaccatgtccagctaatttttgtatttttagtagagacggggtttcaccatgttagccaggatggtctcaatctcttgatcttgtgatccacccacctcggcctcccaaagtgctgggattacaggcatgagccactgtgcccggccctcttactaattttaaataacatgtctcctgcagcttctgtattgcaaatataggaagtgattttggcgagcatttgaattatggtagctgatctgatctgttgtgtctccttactttctaattctttctttactttctgctcttttcctccctctgcttatttgcttcctcttgctgtcttcctttatctccttttcttttcctacaaatttctaaaatgatagctgatgagaaggaagatcactcttacataatttgattcctcagtttccattttcttctttttacaagtataacattctatatttcttttttttaaaaaaattattttttaattgaaaaataatggtacctattgatggagtacgtagtgatgttttgatatatataatgtatagtgatttgatcagggtaattagcatatccatcatctcaaacgtttctcatttctttgtgatggtaacattcagtatcttccttctagctatttgaaactgcattattattaccattatcattttattttatttagacagaatcttgctctgtcacccagactgatttgtagtagcatgatctctgctcaatgcaacctctgcctctcaggttcaagcgattcttctgcctcagcctgccgagtagctgggattacacgcatgctccaccacgcccgactaatatttttttagtagagatggggtttcaccatgtttgccaggctggtttcgaactcctgacctcaagtggtctgctcacttcagagtcccaaagtgctgggatcacaggcacgagccactgcgcctggccaaaactacatattgttaactgtagtcatcctacagtggtttacaacatgaaagaaaaccaagtattaattgtgcaggaaattcattgaagaaaatgcctgtgaagggaaatggggagggagcagggagagatttcagaccgtaatgcaggtctgacacctctgaaagcagagtgggaaggaagagagatagttagaaagagaaaggcttcggcacaactctgagaatgtatcagccagtgtaatagttcctaaggcaactctctctgttggacaactcccagttgggttagaatcacctaattccgttacttccactgtgcccagtcactggctgggaaaatccccagggaagtgcagcctagcatgaacacctcggtgggtcaaaaggtacagcagctagaggttgtcagttagctctgcttccagagcagttcaccttgaaggaagatttgagcacagaacttccatgactgagagcttctggtgcactttacagcagaggaatttgtgaagcaggttcactgttcactggctaccaacttgtccagtgagacagaacactcccacacaacaagttacctgaggtaggtttattacttacagataggcagcaagagatggtagaagcctaggattcattgtgagctattcctccaagtccccggaaacctgctgagggtaagtagagtcatatctgtgcatgccttacttgcacagaagctcagataccccagaaagcagctggttctgtgttttataccccaggatgtgtgatttgctgggctaaagtgtttaagacattttgtttctaggggtggactgaaacagaggttgggtcgttctggccagtccctctctatctcaagatgttgcatttctagcacattcttcagttattcttaagaaccatgagttgggaaaagagggaagaactgggtaggcccaaggccacccagtgaactgtctagcagcattttgcattttgtaaaagcacattaacaatggttttgagaagctgaagtctgtggactgattctccctgtaaatacaggcctgctttactagcacctgcactttctggttcttatgccccctcaaaagtgtactgagtcatttgaacagaaggagactgcccctccagctccccacaatgggaaattgtcatcactgccacaaaatgaatagaaggacttggccaagttcatcttcctttgtttactgcctgcacttcatcccatttggaagagagaagcaatagcattgaatggtctggcttttttttttttttttttgtaatcatggctatacagcagggtaatgaaggtcagagatgggggcttgaaccacctgcctgtggttttgaggtttccccaaatactctatggttgttaagttccataagaaagggacttgtttttcatttttattttctttccaacttttattttaggtttgggggatacgtgcgcagatttgtttcatgggtaaattgcatgttatggggcttggtgtccagattatttcatcacccaggtaatgaatgtagtacctggtaagtagtttttcaatcctcaccctcctcccatcctctaccttcaagtaggacccagtgtctattgttcccttctttgtgttcatgtgaagtcagtgtttacctcctaagtgagaatgtgcaatatttggttttcttttcctgtgttaatttgcttaagataatggcatccagctccatccatgttgctgcaaaggtcatgatttcattcttttttatggctgcatagtatattccatggtgtatatgtaccatactttctttatctagtctgcaattgatgggcatctaggttgattccctgtctttgctattgtaaatagtgctgcaatgaacatatgtgtgcatgcatctttaaggtagaatgattattcttttgggatttatacccatgaatgggattgctggattcaaccttagttctattttaagttacttgagaaatctccaaactgctttccagtgactggactaatatacattcccatcaacagtgtataagcgttaaagggacttaactgctgaatagtcttcacccaactcaaagcctggctctcagtagatactcaatatattgcttatacaattaaaggaatggttaaaaggaaggaagatgtatgcagaatctgtgtactgctaagtcagcaaacatttgctgagggtctgttgaatttggtcctgctcaacattgaacttgcccacttctcaccaccattaaggctccagaaaatttgtttatccacagccttcttcgtctaccttattaccttgtcatttctttgagacctaatatccattcctcctgatctccagctcaactccctagaatccatagcttctagagttttgtttatttattccatttttatttatttgatttattccactttcattgaatatcaagacctccaggcatagttccaggcacctggtatgcagcaacaaatatgatgttcagataatctcttgctgcataaaaaagagcctgatcccacagtggctggaaacaaatatttggtattattgctcatgactctgtgttgattgggctcacctacgtggttctcatttcaagtcctatgcagttgtagtcagataatgactggggctggagtcatctgaaggcttgactaggctggccatccaagatggctgagacacatggctggcatgatattggctactggttaggagctcagttggtgctgtcgcctggagcactttcatgtggcctttctatgtggtttgggcttctcgtagcatagtggtgtctgagttccaaaagtgagtattccaagatataggaagtagcgcttgatagtcttttaaaacatggactggaaaagggcacagtatgatttccaccatattcaatacgtcaaagcaatcatggaggtcattaaagtcaagggagagggtgtagatcccaagagattgttgtgtgtttttgtttgtttgttttttgtattttttttgagacggagtctgcctctgtcacccaggctggagtgcagtggtgtgacctcggctgactgcaacctccgcctcctggattcaagtgattctcgtgcctcagcctcccgagcagctgggactacaggcgcccaccaccacatcagctaatttttgtatttttagtggagacggggtttcactgtgttggccaggtgggtctggaactcctgacctcaggtgatctgcctgccttggcctcccaaattgctgagattactgatgtgagccaccgtgcctggccctaagggattgctttgatgtaaaaatgtacagccatttgaaaatggccacaggtggtctctgctgtcaaggacttcagagttgataaagagatagtgatgaaacctatagtaggctgaatcatggccactcaaagatagcaggttctagtccgcggaacctgtatatgttaaattataaggaaaaggagtctttgcaggtatgattaaattaaggatgttgacatggggagattattctggattatctaggtgggccctaaatttgattgcaagtgtcttataagagaaaggcggagagatattacacccagaagacaagaagttgatatatccagatggaggcagagattggggtgatgccactccaagcaaggtaatgctggcagccaccagaagctggaagaggcaaggaacagactgtcccctagcacttctatagggaacgagctctactgacaccttgatttcagtttattgcaaccgatttcagtcttctgacctccagacctgggagagaagaaattcctgttgtttgaagccatttagtttgagatcattgttacaaaagtctcaggaaatgaatacaaacccagacaatgacaagcaagggtggaggtgatatggaggaagcatataggaggcacctgaagcccagcccagctgggagagaagaaagcaggaatgcttctttaagctctgatgttcaaatgagaacacatggacacacggagggaaacaacacacactggggacagttggagagtggggggtgaggggtgggagagcattaggacaaatagctaatgcttgtggtgcttaaaacccagatgatgggttgataggtgcagcaaaccaccatgacacatgtatacctacgtaagaaacctacacattctgcacttgtatcccagaacttaaaaaaaaaaaaaattctgacgttgattcatccctaggaagtgtggcatcatggtgatgttcattcatccctaagaagtgtggcatatgacaacatgtggaacttgaatccattaaacttctttttctttacaaattacccagtctcaggcatgtctttattagcagtgtgagaatggactaatacaaatattatgatgaatgaggacattctcatatcttccacaaaaccatcatggaagacattatccatcatttggttacatttcccttatgtaaggatccaaggggatctggagtactgcttttctgtttgcgtctcaactctgccacatactagctgggtttataggctgctgtgaggtttcaatgagtaaatcaaaacctgtaaacacttggtgcatgcatagtaagtacttaaaactggtattgttataattttcgggatatggtaaaggatattgtttttctggggaaagacactaggcccatcatgggggtaataccctcgtgacctcgtctaacccaaattacctcctccaaatgccattgcactgggggctagggcttcaacgtgtggatttggtggagaaagacaaagacattcagtccataacaattttccttggatttttatgtatatgatcaagtcacctaggaatgatgactgtttcatttcttcctttctggacatttcccccctgtctaactgcactagctaggatatccaggacaatgtggaatggaagtgaggcttatgggtatcagtgctatgataccatccacagggagaaacctttggctttgtatgaaaagctgatgggtagggatattgatatggtttgtctgtgtccccacccaaatctcaacttgaattgtagctcccataattcccatgtgtcatgggagggacccagtgggaggtaattgaatcaagatggggggtcttttccatgctattcttggccagttgtcagcctgcccaacatattgtgaaaccgtgtctctactaaaaataataagccctctcttgcctgctgccatgtaagatgtgactttgctactcctttgccttctgccgtgattgtgaggcctccctagacatgtggaattgtgagtccatttgtgagtccacctctttttctttataaattacccagtttcaggtatgtctttattagcagtgtgagaatggactacttcagatgtcatgatgaatgaggacattctcatatcttctgcaaaaccatcatgggagacattatccatcatttagttacatttgccttatgtaaggatccaaatggaattttttttgaattctattctaagaaaaatcatttcctttcctgtgaacagctatacttccctttgttaaatgatgatattcatgtgtcctttatgttttctttttcttttgctctggctattagggagctaaaacccaagagcacacgcaatcaaaataaccatattaaatgagttttcttatgtatttgataaataaataatttttcttttggtttccctttgggtgtaccttttattgcaagctgtctcaagaagtttttttcacagtaaatggggataaaattattttaaaagaataatacctgacctgattattacctgggtttatttcattgactgaatggtgagactaatgaatggacaagagctttatgaactgtaaaatgccgtgtctgttattaactaggggaagaacatgattgtccttgactttaaccaatgtaccttgtgtcttccttagttggcactgatggttctgagttaggtaaccatgctccctaaagcctctgagatttcccctgagcatcctggccactcagtgcttattttgcaccactcttgtgtgtccaggatgactccttcaactttatctttcttctagaaagttgctatccattgtttacatccagtggctcatgcattcatagactgcagcagcattttctaagcaccagctgctgggtatgtattggttacctgcccagcaacccttttctcttcttctttgctgagaccatcccattttcattcatgcatcagttggcaatatgcccagagaaatggagccccttccttcctcatgctcttaggcatggaactcagttggcccaagccaggcatgctcatcttgtttctctcactgctgactggtttagccttgggcacatgacctggttctcagtagtgagctagtaaggatcagaaaaaccacaaagccatgacattattgaattaacctgtctggaccacctacgcctggattttgtgtgggagatacaataaatctggattataggttggtgcaaaattaatatttaaatcacctgtagttcaactctgtgttgcttgcagtcaaaagtatccttatcaggctgggcacagtggctcacgcctgtaatcccagcattttgggaggctgatacaggcggatcacctgaggtcaggagtttgagactagcttggccaacatatagtgaaaccctgtctctactaaaaataaaaaattagctaggcgtggtgacacgtacctgtaatcccagctactcaggaggctgaggcaggagaatcgcttgaacctgggaagcagaggttgcagtgaactaagatcccgccactgcactctagcctgggtgacagggcgagactccatctcttgcaaaaaaacaaaaaaagtcctaatcaactgttttagtttggatgctcactgaagtagactctgaggcaaggatttgagtgccaatagtttattaagcttgaggaggtgggggaaaggggacaggcaagggagggaagtggcaagaaagatgcattatcatgtcagttaccagtgtggggaatcacagtttaatctctctggggaactctggaaaatgacacagagcagggatttgcaaactattggcccatggcaaacctgttctgccacctgttatttcaataaaatgttcctggaatacagtcacaccctttcatttatgtatagcccatggcagcttttatacaacagcagcagagttgagcatctgtgagagacaatatgacctgcaaaacataaaatatttactatatgaccctttttcaagaagtttgccaaccctagtgttgagcatgtagctcagaatcaccccctggaggagtgaaggagctgggatatttatacatccctccagttagtcactggtgaagacctaatgcaggaggtatgttaattctccaggacttccgacctgtcctgtgcacaggcattgtgggccctggccaagcaaagagatgtaaataccgattgttgggatttgtgcaagtatggaccctactggtccataccagtacactaacagagatggccacatcagtgcatccagagatggctgagaagtgcacctgtcctccaggaacccatagtctgaaggcaaggttggaaatggccaaacatttttatttttattttttttgagatggaatctcactctgtcacccaggctggagtgcaatggaatgatctcggctccctgcaacctccgcctcccaggttcaagtgattttccctcctcagcctcccaagtagctgggattacagggacctgccatcatgccggctaattttttgcatttttatagagatggggtttcaccatgttggccaggctggttttgaactcctgatctcaagtgatccacccacttcagcctcccaaagtgctgggattacaggtgtgagcaatcgcacctggcctttatttttattttgtgagacagggtctcactctgttgcccaggctggagtacagtggcacagtcatagctcactgcagcctcaaaatcctgtgctcaagtgatcctcccacttcagcctcccatgtagctggaaccacaggcctgtagcatcctacctggctaatttaaaaaacaaacaaaaaaaaaaacaaaaaaaataaagtgtgtagagacagtctcactgtgttgcccaggctggtctcaaactcttgggctgaagcattcctcctgtccccgcctctcaaagtgcttgggattacaggtgtgagtcactgtgccctgctcaaacattttataattaagtagaaaaaccgacatgtcagctggggtcccctgaatcctcaaagatctaggtaagatcttctatgcaggctacttcctgctaatctggggagggcgaccttctcaaggtcgtatctgcctctggccctggtgcccccaacccacgctggctctgctttttcccctacaggagcttaagtgcagaactttgcgtctcccattgcctgcaggaaacctactcagctagtgagttcatagggcttcactgaagactgggggattctggaggggatgattttctggcacattcaggcttctagaaccctctattctttccccagctctgcttctcgtttttttttttgtctggctccaaaaccttactccttttattgagcacattatttctctccagttcccacctctgcatttcctttcctgaatgcttctagggcctcagcagaacaaggaacgcctcattgatgacgttaaaaaacaacaacaacaaaacaacctaagacacaagacacagacaaaactttttttttttttttttttttttggtattctccagacaaaacgtttgcagcatgagatgaggtcccctttggaaacatctccccacattctgtgattctgccaagtcctctaaattttgtctcctccttcatccaccaggtggatttcaggactcctactgtcagaggcttggaataaacctctggcatgctttgcttctgttttgctttctttctttctttttttctgagatggagttttgttcttgttgcccaggctggagtgcaatggcgtgatctcggctcaccacaacctccatctcccaggttcaagtgattctcctgcttcagcctccagagtagctgggaagctgggattacaggcatgcgtcgccacgcccatctaattctgtatttttagtagagatggggtttctccatgttggtcaggctggtctcaaactcctgacttcaggtaatctactcgcctaggcctcccaaagtgctggggattacaggcatgagctatcgcatccggccctgtttggctttctaaaatagactgtgtgtctcacccagcatgacgttagatctgtttagcatgacagcattccattgagtcaactccttggacatactatatgttttgtttccctggtagctaattaaataagacaactaagtgcagtctagaaagttcctctcataacaaagttcccaagaatttacgtctttgctttacttacttactttttcgtggtagttgaagttcaagtggaaactgattataaaggagaaacctaaatcaagttaggtgaattctgcagtatgaactgtgcttggaaaatctaactggtaatgtatccacattgggaacttggtccttcctctcacaaagaaaattccaggtcaatttcatcccctatgctaagcatttgagtgttcaggaatgtgattttagttttataaaaattgttctttttaaaattcctgtcaaataatcagatttttttctcagcacatttagaagtaaaaatggaaagtttagagcattttgatattttagtatttccatgaagtcatttaaccctcccagactagtttcagagttttgtcttccagcccatctttgtgtctcactgtacattttctgcatgtacaatgagaggtgatttttaattggaatcccttagatttttagagagaaagctctcctcctctattcttcttcctctcctctcactgtctctcattttaatccagagaatcaaagtgtctcttacaggcttggatatcaagctgaactgttaaaaacagtggggtccaggaacctgagtttaaaacaagcacctctgattgtctaagtggacttagagaaagacaaatgctgtgtgatctcacttatttgtggaatttaaaaacgttgaactcatacaaaaagagtagaattagctaagtgaactaattcagacagagaaagacaaatgctgtgtgatctcacttatctgtggaatctgaaaatgttgaactcagaggaaaagagagtcgaattagaatggttgccaggggctaggaggaaatgttgctcaaagggtacagactttcggtgataagatgaataagttctgggcatctcatatttggcacggtaactatggttaacaataccatattgcttacttgaaatttgttaagagagcagctcttaaaattttttttttactttttgtgggtatataataaatgtatatatttacgggtacatgagatgttctgatacaggtatgtggtgtgtaataatcacatcatgaagaatggggtatctataccctcaaatatttatcctttgtgttacaagcaatccaaatacactctttcagttattttaaaatgtacaattaggccaggcgtggtggctcacgcctgtaatcctcacactttgggaggccgaagcaggtggatcacgaggtctagagtttgagaccatcctggccaacatgatgaaaccccgtctctactaaaaatacaaaaaatgagccaggcatggtggcatatgcctgtagtcccagctactcgggaggctgaggcaggagaattgcttgaacccaggaggcagaggttgcagtgagcccagatcgcgccactgtactccagcctggtgacagaccaaggctctgtctcaaaaaaaaaaaaaaaaaaaagtgcaattaaattattgactatagtcactctgttgtgctatcaagtagtaggtcttttttttttttttggagtgaagatctcatttctgttacccaggctagagtgcagtggcatgatgacagctcactgcagcctcgacttcctgggctcaagtgatcctcccacttcagcctcctgagtagctgggactacaggtgtgccccacaatgcctggctattttttgtatttttagtagagatggggtattgccatgttgcccggctagtcttgaaatcctggccttaagcgatctgtccgccttggcctcctaaagagctgggcttacaggtgtgagccaccacacctgaccaagtagtaagtgttactcattctttgtaactatttttcttgtacccattaaccatccctacattccccagcccactacccttcccaggctctggtaatcaccatcctttcactaagagaccagatcttaggtgttctcatcacataaacatccaaagacaactatgggaggtaatgaatagggtaattagctggttcatggtgatcatttcacaatttgtgtatacatatatctccaaagatcacattgtacactgtaaatgtattccatttttatttgtcaattttacccctctaaagctgggaaaatgaaataaaataagcatcctgggcaggactggctgcatagttttcagggcccagcacaaaacgaaaatgtggggattcttgttatgaaaattataggaattctggctgggtgcaggggctcacacctgtaatcccaatacttttggaggctgaggctggggagttgctttgagtccaggagtttgagaccagcctgggcaacatggcaaaactgcatctctacaaaaaaaaaaatgaataaattaaaaaataaataaataaataaatcagccgggaatggtggtatacatctgtggtcctagttactcgggaggctaaggcaggaggaccgcttgagcctaggaggttgaggctgcagtgagccatgttcatgccactgcattgtagcctgggtgacagagaaagaccttgtctcaaaaaaaaaaaaaaaaaaaaattataggaatttcaaaatgccagcatcacagtggggtcgtctaattatggggccttgtgcagttaccccaggcagcatagcaggaagcctggaagagctttgctgcaggattcagatcccagaccatggtgcccatgagtttcaagatcttgtaacatgaaggcgtgtcttcaacagactctctccaaagaaatcctctcttgctcttggcccttctttgtgcctgaaaagcgtgagaagagggtgtaagcaggacagaaccacttttatttttatttatatatattttttgagatggagtctcgctctgtcgcccaggctggagtgcagtggcgccatctcggctcactgcaagctccgcctcccggggtcacgccattctcctgcctcagcctcccccgagtacctgggactacaggcgcccaccaccacgccccgctgatttttttttttttttttgtatttttactagagacggggtttcaccgtgttagccagggtggtctccgtctcctgacctcgtgatccgcccgctttggcctccgaaagtgctgggattatagtcgtgagccactgtgcccggccagaaccacttttcaaagattttgtttgaaaatctgccttttgattttgtacttgattttggaattctttattattattattattttttgaaacgaagtctggctctgtcacccaggctggagtgcagtggcgtgatctctgctcactgcaagctccgcctcccgggttcacgccatcctcctgcctcagcctcccaagtagctgggactacaggcgcccgctaccacgcccggcaaattttttgtatatttagtagagacggggtttcaccgtgttaaccaggatggtctcgacctcttgacctcgtgatccgcccgcctaggcctcccaaagtgctgggattacagtcgtgagccaccgcgccgggcctggaattcttgatgctttaaacaaaacttaacatcttgcctgacatgtttttgtagcccaacaggataactaaaacgccagcattaaaactcagtccctggcaagatgttgtctgtgatctccttcatcttcacgacaagatcatctagggttgtatgctgaggttagcagcagagtctcagtggagtcgaccctgcaggtgggaagccacacttggaattcctccatcgtgcttagttcaccttgaggactaggtagctatctaatggcagaatggtttcaaaacccaagtatctgtgaagagctttctcttttgtgaattcttcggtccagctcagtgacttccaactgttcgaggggcatagttatgacttaaaatgattacatacacaagtacatgcacactctataaattatggttgatttaaaggaatctcaggagtaattttgaccacaaataatttttcctcttctgtactaactatggaaatgaaatgtttgtgtaatatatgatttcattttgccagaatatatgaatacttctgtgaaagtgtcctgaaataaatgaaatgctgtctctgcaaaaaaaaaaacctaaaaaacaaaaacagttctttggctgtgacatggacatgaataaaaaggttataactagcatcaaattcaagcatttggttttattgcttatgtgaacacagcatggaacatcttttgattcacgttttccccattcttagtcgtgttatctgttcgtgactatgcaagtggttttgtctctcagggacatttggtcatgtctggagacattttcagttgtcacaactggggatgaggaaatggtgctactggcatctggtgcgtagacttcagggatgccagtaaacatcctgcagtgggcggaatagccctgcatggtagagaatgatccactctagatggtgtcagtgccctctaaacattacgtcctgggctgtacccactctctggatgtgaaaatggaggcctagggaggctaagcacttatttattatttctttgtagttaaaaaaaagtccatcttgttccaggaaggaacaatttactttctaaacatgaggcataaaacagaaataactaggaaatcggtggaaatgtgttttcatggggaccgtgtagactgaggacaaattttcaggcttctatttgtccggtgaggttagtgcttgtgcgctgggccaagtcaacatcctcttagcggtgtcttgtctccttcctgatttagaaaaggcaaacccacctgctgtcatgaaaaataccttctagaagctaccgggtaattgggtgatatttctggatttgtctccctgtctaatgtacatcagttaaacttttgactcttcagtgccttctggagaaagtaataatcggaaactaaatcgacttggttttttctctccccctttgccccgtatttgtaaagattaatcttcagtatctatgagtgctgggtgatttgcggaaactgcagctgctttgtcaatatcagcttggcctccattgatcaaaccctcatttaggcgttcactgccgtctgctggaaacagcccagggatgaggagggaagggaaaaggccacttcgggaggccaccttgccttggagtttccgtcgttttccgaggtgagcttggatgtcactgctcagcacagttgattaaagaggttggtgctgtgagtgagtcactgtgtgggaatcaatcccgatggtggcagatatgaataaagcgtcggtgtaactgtcctggctggattgtttttctccgtctcaccatactgttttccctctgcacgtgtctgtgacctccggcaggcttgcagataaaagtgatgcatcttcattttgtcggaggagttaattttgtgtgtattccaaggtaagatgatactcacggtgcttatatcttgggcacccactgtgcattggacactttccataaattaactcaaatttttcttagcagcttgctatggctcttcactgtttctccaattcgatttacaaaaccttgatttcagtgggatccctgtttgctcttgcaaactcttcactcaccacctgctttttgcccactccacttcagctgccctgaactttgtgttgctggaattgactttgctcactcacacctctggtcctttgcacatgctgtgccctgggcttagtacatttcactttcatcctcttaacctcgttcatatcttgcttgggacaacagatacggctgtaagtatcagaaaactctattatcatggcttgaaggtgcaagggtttatttggcttacacaataagctaaacagtaggcaagccatgttggtagagtgaatcaaagagaccatcagaaacccccacttttttcattttcttgctctgctgtgcaatttctatcctcatggttacaaaatagctgcttcatctccaggcatcacgtcagcaggcatagaagccaagggagggcagcaagccagaaaactaaaggtgcgctctcccttcttttcactggtcacaactacgtcagatggccagccctagctgcaagagatgctagtgaaagatgatttttagctggatacattgtcgccctcagcaaaataaagatgcatttttcttattagcagaatcctaacaattaagattcagtgctcagttttgatgccactcagctgagtggtcctccctgaatccctgtgacagagttgggacacacaggtattaggcaatctcatagatggcattggagttacatgaaattgtggtcttgtttccctatctggattgaaagctccatgaggaggacttggtctacctttcacacagttgtatctctactacctacatagttccagatatatagtagatgctcaataagtaataaatgaaggagttacatgaaattgtggtcatgtttccctatctggattgaaagctccatgagaaggaggacttggtctgtctttcacacagttgtatctctagtacctacatatatagtagttctagatatatagtagatgctcaataaatacttaataaatgaaaaatagctactattttgcccctttgtagttgacacctagagctttagggagataagataacttgccctaagtaacacatgtactccttaattcctccattcagtaatgtttatagtgcaccttctatgagccaggtcttgtttcagacacttgggatacatcagtgaacaaagcagataaaacgactgcctttgagaccattatccctaatattttattacaaaaaatttcgcacatacagcagagttaaaccaatttcatagggaacacgtgttcagttactacctaggttctaccagtcactggggcacattgataccagtgggggaaggcacacagtaaaccggaaacaaaacaagtaaattacatggcattgtagaaggtggcaactgctatgagaaatacagagaaggtaacggggtgtagggcgtgcagttcggggtggtggtggtggccaggcttggcctcattgagatggcgacagttatgcaaagacttgaaggacatgagggagcagtgtcgatattggagggcaaagcagttctaggtggaggcaacagccagtgcaaaggtcctgaggtgggaatctctgttccaggaggggcaaggtggaatgtgtggttggaggaggagcgttgatggtggctgggttagtagaggaggaggagtttggggaaaaagatcaagggaactcagctttggacaggctatgcttgaacaactcaggggcagagctgggatttagatcccagacctcacaaccttcctgtattagggttctctagagaaatagaaccagtaggatatatatgtctatttattatatggattgttgtatgcagttatggaggctaggttccatgctctgccatctgcaaggtggggtatgaggaaagccaatgacattaagtcccagggtaagtctgaaggcccaagaaccaggagctctgatctccaaggtcaggagaaggtgaatgtcccagctcaaatagaaaatgtacacttcctttgcttttcgttctgtttgggctctcaacagatgggatgatgtctgcccacatgggtgagggtggtcttctttttttctttttttgagacggagtcttgcagtgttgcccaggcccgagtgcggtggcatgatctcggctcactgcaagctccgcctcccaggttcacgccattctcctgcctcagcctcccgagtagctgggactacaggtgcctgccaccacgcccggctaattttttgtatttttagtagagatggggtttcgccatgttagccaggatggtctcgatctcctgacctcgtgatcggcccaccttggcctcccaaagtgctgggattacaggcgtgagccaccgcacctggctgagggtagtcttctttactcagtctacagattctaatgctaatctcttccagaaatgccctcatagacacacacacccggatgtaatgttttaccagctatctgggcatcctttagctcagtcaagttgacacatgaaattaaccgtcacactttaccattttgccaacatctgtcccccagtcattcaaagacactgtgaccagctggccaggtggcaagaattcctagggcacaagcctgaagccttcgggagaaacttcagctttacagggggcagaatgtttggtaactatttagatttaaagcagaagcactttggattgagcaatttcatatgtgacaactgtctttgccacaagcaacagcagagacctgcagatgagaacacctttatgaagaacaagaccatgctttgaagttgggcagagatcttggttcaaatcctggctctgctgcttgttagctaagtcacttcaggtaagcgatttaacttctttgggccttgctttcttgatctgtcaagtggaggttcataatagtatcaccccttgagggcagataaactgatgtatgtttatgcatacataaactgatgtatgtgatgtaatttagcacggtgctggtccacaggtgaatggagatgatttttgactttctgtctcgcagaaagtctgtacctccccaaggacatctcatgcccacagcagcccagcattgagtcctcaccaacccagactgactttccagcctcatatcctcaaaggatctgacattttccagccaccaaccttggtttgcactatgcccttcatcaaaaatgtctttgcttctctttgatgcctgggtatctattcctttagaacccatttcaaatttctcctccttaaagatgccgttggtcactgttccaatctgtaggatactctgttttgcccagatcccttttgcactgccttctgggactcagatacagagggggcaaaacatcccggaaggggtggggcccatggactgctcttggagtggggacagagatcaccacgagatggcgctattgagccatcactgtcaactggtttttctctgttttcattttcttacttgatgagaaatgtgtgatttccaaatagtcccagaaggaatagaactgtgactgtgtcccaccactaaaaaggtggttttgcatatctctgatcgtcctatcacatcgcccactgttaaaaattccatccccacatgcaggggatttagaaggagaatatcacacacttgctaccacccccaatccatgcaaataccttggtacttgctatagacacttggtacacaaatactgcctcagtcttttattaaattatattttatatattgcatcagagtattaagcccttaagggtaggacctggggtccatgccaacttactagaacggtgtcgacttctctaggatatggaatccacacagctccttggaaagctggaaaatgcagttttgaagcaaccctgcttcatttccacaccaatggaaaggaaagtgataaatcctttatggccaagagtccgttctgtttatttcttcctggaaatgctattgatggtggctggggaagttgtttgttttttaatctttcccttggcaaggtctccttactcatagcccttccttatgttccccaaatggtgcagggggcagtgttcagaagcccagtatgcaggtcttgcacagaggagaattatggcttaaagaaacttggctaagtgtggtggctcacacctgtaatcccagcactttgggtaggtcaaggcaggccagatcgcttgagtccaggagtttgagaccagcctgggcaacctgatgagaccccatctctacaaaaaattagccagggatggtggtgcatgcctgtagtcccagctactcaggaggctgaaatgggaaaattgcctgagtccgaaaggtggatactaaagtgagccgagattgtgccactgtactccagtctaggtgatagggtgagaccctgtctcaaaaaaacaaaacaaaataaaaaccaacaacagaaaaagaaacttgggtgggatcatgtgtccaggcctcagcactgttgtcccttactctaactcctgcagagaggtccttgaacagacgtaagcggacacaccttgaagtcaaggtgctctttgcaaagcaacacaatgttattgacatattccatttgaataaccaaattttgtagttgattgtgcgctaaggtggatacgcattacattatgttcttatgtagggaagtagaagttagtgccgagatttaaagaaaaatcagtggggaaaataacagttgaatcttatttgtttaaaaacttaggacttatttattcttctgtccacccattcatatatacatttaacaaaagtatttgaaattagttttatattgctatttattttaaaaataggtattatacacgtatggctcaaaattggaaagatacaaaagagtgtatagtaaaaggtagtttccactcccatccttgtcctaaccagtttgtttcttcacagaaatggcaaccactattgatagttttctatgttccccttgagaaatattctatattgtaaatgtatattcatgtattcatttattcacccatctatccatttattcatctacccatccatttattatctagccacctatccatagatggatccatttatgcatccatcaatttattcatctatttacccatccatccattcatccatttatccatccatctatctatttactttccattaatctatccattctttcatccacttatccatccatctatccatccactttgcattcatctatccattcattcatccatccatttatccattcattcatccatttatccatctattcatttacttacccatttatccatccatctatccatccacacacacatccatttatccatccatccatctattcactcatccatccatttatccatctaatccattcattaatccatttacccatctatgtcatttttttccaggaagaggaaaagggcagccattatttggttttagatggtagaccaaatttgtgctactgttccactggaaaagagatttggaaccactccttggcgttaagccagccactccaaagctgtagtgttgcaatgtcatacatctgtcagggaaggctgaacattttaaaaacaattgggtatggccattcagattttattttggcccagcataatgagtttgtgtttgattctgaaggagagggagatttgtaataaatcagcaagtgaaattaaaagtgagccagtgaggtgccataaaagggtggttggaatcagacattctcaaatccatatcctatccccacccatgttaaaagctatataggaggttatttaacttcttgggagtctcaattttcctcttatgttctgagatggggataattgtatttttctttgcaggttaaaggctaacacaatgcttggatatagtcagtgctcatgtggtaactgcccttaacattattaagcccacataattctcttcttttttgtaagcagttgagatctttaggttgaagattcaatatacaatgtaacagagtcagagggtgggtggcaaaaggtacatacatactgcagggcagggacttggagtatggaatggagaaatagcagaggacatcttccagctgcagttgggatgggtgctgagctacaaagctactagagaaataggaaactcaggtctcatcattgcagggacccttgtttcctgcaaagaatccttggagaaatctctcccactgtctctgggcattgtattcagaaatgtctggcctggatgatagtcttcctgcttttggcctcaccctctatccactgtcctctgctgaatctttctaaaatgcttgcttaaaactccttatctccttcaggagaaagttaaatcctttaccacacaaggccattacctgggggccctttctaactcctcccacctcaattttgtcctctttctgcaggtatctaagtgtcatgatttagatgtcctggcatgcactgtgctctttttctggaagcctcctttctttcttcatccaactacctcctcttcttccttcgagattcagctgagactctcttgagcaaattttccaagactccttaaggggaaggacctggtccaagttgacttggtgtctccgtcatcaagcacaatgcctggttcacaatggattcttcatgcatctctttctacaagatgagaaggatcagagggtgaggattggagctgggtgtcttaaaaatctgtgagagtggaagctaagccagtgatgtttgctttgtaagctattcttgtgatattacaatccttcagagtggtgaggttggtgggagtggtaaaaacaaacaaacaaacaaacaaaacctagtttctttgtcttggattttcctgtgtcagtttatagagagagactatccatcatattttattttagcttaaccaaagtcctactttttgttgtttctttttttctttgctgggatcttaaaagagattgaataaaaattcagttgtaggaatggctttaccttcctctctggtcttgttgttttgtttttagactatgatatcacatgtcaagactatgatatcatatcaggactaggatatcaagtttataatagaacaataattatgtattatttaaacttattttcatcaaactataactaatacacaatggattttttaatggtatatacagatatttaaaatttgaaataattttagatttatagaaaagttacaatgatactatagcaagttccaagaaatcccttctcagtttcagtttttcttaaattttgttgttgttgttgagacggaatctcgttcgatcaccaggctggagtgtggtggcacgatctcggctcactgcaacctccacctccttggttctagcaattctcctgcctcagccccctaagtagctggcactacaggcacacgtcacctcacagctaatttttttatttttagtagagacgaggtttcaccatgttggtggtcaagaccaccaggctggtcttgaacttctgacctcgtgatctgcccacctcggcctcccaaagtgctgggattacaggtgtcagccattgtgcccggcttctttaatgttaaaaaaatgttaatgtctttgtcacaactttggaaactattaattgcattccaaattttatttgaatttcaccagtttttctactaatgtctttttcctgtccaggattcaatccagagtttcatgttgcatttattctcacgtctctgtagtctcttctggtatggaacaatttctccatctttccttatttttcatgatcttgatagttttgaggggtactgggttagggattttgtagaattggacttggtgattagaacctaggtctggccgcctacccatcacagtatcagtaaaagcctcccttgaaattgaccaatggcatgaacatttcagatgagtctgccatctttggtgctcctgggacacgagagagacctgtcttggagacagagacctcacagactcagagattcaggtgctttttctggtaatgattttgtctgcgggctgatcacaaaggtggatgagactttggccaaagctaaggctgcagggtctgggctaaaaaattccagaaaaactaccttgccatgggaggctgagttccaaatcgcagcccgcgtgcagcctgctttaccaaataatgaggcactgggtgctttttaaggcagctgacctttggagcaaattatccaaggaaatctgattagctagttcactgggttcctgcaaaatggagcttggtgtgtttctgcagcagaaatgtcagcataattggagtttctggagctcaaagagcttctttcttattgtttccatcctttggaggaaaaaaaaacaccccaaacaaacaaaacccaaacccccaaagaattgttctttgacttacattctttgcttttgcacatggttcagaagctgctcctgactgtgtttacgactttattaatcaggggaacagcccgaacatcatttaaacaaacaaggccaaaaaaaaaaaaaaatccatccctaaacagatgatgtgagcttaatagagatggccaagccaaagaccttaaataaataaactgactttaatttgtaggaaggagcatggggtggtcattacttgaggctgtgtgccatgcgatgtaaccaaatttgaaactcgctaatttcattattttaatggaagtctgcctcccattcattaggctgacatatgactagccattagtaacagtccatttccaaagctatggtggataaagggtgattggaaatgagcgagggccaggcctggtggaggctggcaatttcagaagggaactggtgggtgggatttatgcaagaggcagggaacacaactaggaaaattgtcaatgtggatggaggcagcaaaccattgagtccaaatacaggcttgagagacctgggtttgaattctggttctgccacatactggctgtgtgaccttgggcaagttacacccccgcactgagcttcagtttgctcatctgtgagatgggagtaatcatagttcctatctcgtagggttgcttgcaatgactcaatgaggcaaattcttaggaggctctagtatagggcttggcaaaagtaaccacttaataaatggtagctatgatgatgataacgttggccaaagtccccagtatttagggacttggagattttgctaatgaagaaatgaaggctgacagaaataaagtaaggtatccaagtttgccccgaacttggactcaaatttctgattcttaatcctatactcttaaaaaaaatcctatactcttaatcctatactcttaagacccgtatttttaaaattgtttcatttcttgaacaggccagtaattcatatgattgaaaaatttaaaaacaagagtatgctagaatagtcagtgaaaattgtcccttctgcctggaacatttccttttcacagacagccattgttacgtgtttcttctttatctttgcagaatttcaggtacgtacaagcaaatacaaatgtatatgcacttcttttttttttattacacagacagttctgtatcctgccttttaaaacttatatcctgcttatctttctgtatcagggtatagtgagttctttcattcttacttataattatatgtttttctattataatggctatattatgtcttatttaattatttctctcttgatgaacagttgggaaagttctcatcttttgctattacaaaccacaatgcgatgaataacattgcatgtatgtcattgtgtacaggtgtacgtatattctaggataaatttccaaaagtagaattgctgagttacagagtgaatgcatttctgattttgatagtgctcaaaggtctgggggcacatagagatggtgctttagcagtgagcttaggctgacagcggttaagagagacatgcctcaggttgccagttaaaaaaaaatctgcataatgtgttgcttaaagaatgtggtaaggtgaaagcttggaaatactggtgtcattggaaagacagaaataagacagagattgtgttgggaagagaacacggaatttcgagtaatttctgcctgggtttgcatcttgaccctgccactcctggctgcatgaccttgggcaggttgcttcacatctctgagctcagtatcctcacctgtaaaataaagaccatgataacttccattataggctgctggaggaagtaaaaaagaaaatataaacagcagttagcatgatgcctggcacatggtgtgcattcaggatataactggggcctttgggtgagtaaccaagttcataatgactcatagctagctaacattattatattatatatactatactgtattagtgggaaatagctaacatttattgagtgtttactgtgtggcacgcactgtgcttactgcctcccatgaaacattccacttacctctcataacaactctgtgaagtattcttgctcacctcagcttacagatggggaaacggaggcaggacactcaagtactttgtctgttgaaacactgtgaacaaacgacagagcttatatttgaactgaagccacttgtcttggagggctcctctgatcccacatcctgttctttttttttttttttttttgggagatggagttttgctcttgttgcccagtctggagtacagtggcgcaatctcggctcactgcaacctccctctcccaggttcaagcagttctcctgcctcagcctccggagtggccgggattacaggcacccaccaccacgcctggctaattctttgtatttttagtagagatggggtttcaccatgttggccaggttggtctcaaattcctgaccacaggtcatccacccacctcagcctcccacagtgctgggattacaggcatgagccactgcacccagcccatcctgttcttttgatccacgtattataacataagaggctgacttattctgagacaaggacatcatgggtggagcccccttctcatctcggtgtgacctagttcagcttccccatctcttaggcagataccattgggttcagaaaggttcaaggacactttttctcctcttagcttagtgcttcctcaagtgatccatgacttatgaccttatgacgatgccgtgtggtgagtctgaaatcagatgaagatttttatcccgacatgatgaacacaagcattgcataacctgactcgggttacccaggatctttcctctgcttgtggtcaccactgctaggattttggaagaaccctttaaaaactaagctctctgaggacaggcatttttgtttggttcactattgtgatgccaatgattagaaaaatgcctgggcccataggagggactcatgttcaatgcagaggtggataaatgagaaagagactgtttgccgcagaatactaagagattttattgttcttgtcataggaaccaggcaatattccagacacacatgacatcagtaacatccatatgtctgtgatggggtaggagagaagactacttttcaggtgggacattttgattggagagggtctctgattcagagagtgaggtgagctattttcttcttgggagttcttggcatttgataatccttggtgtttatttcaaaatatggaagaatttgagatttacttagacatcttggcatgcagtgctaaacctcagacttcctgaatttatttaccagctaggggaagcatattcccaactttaattgtatttacaaagggctctaatctggtgtgaagtctgaaggcatatttgttgtaggagttactcaattagccagtgagaaaagaacaaaggaaaagtcattatgcagatgtatgcccattcaaatctattccgcctctagatgctttcttcgtagtgaagggaagaactccagtctgcaagtctctcgtctctgctgtgttttctgctaattctcttctaatattaggccatgaatgattaataatattgcattttgacactgttagattttgtcaatttttttcaatataaaagcagataattacagattactttaacatccaggaagtgaaatcaaccatgaattacactcagactcatccacgaccccttgaatatctgtcttttttttttcaataggagattgaagtttctttagtcaattacacaagtcatgtctgacaattgagaaaatgctgttcacataaaacatcataaattaaaaatatacagtgtttatattttaatacagtagggtcccaggattcaaacaaagaattttgatctcagaggttgcattatgtagttatgtgttctgctttaaagaactatactggaggtaaacttgaaactgcctttgcagaaattataactgaggaaattatgacagtgaaagagatcagacctaaccaactacaccttttatctaatcttaaagctatccttattcattcctgggcataggccgaaataaccttgggaaggaatttagtttacagtttgactctgaaacaaaattgataatagccgtttcctgaaaagacctccttcttgcctggtgaccagtctgcctttgtaggactaacaaattggctacaagattggaaattatggtttaggggtcatgcagcccctgactccaagagtctgaacctccccagattgctcctagggatagcgtcattattgtaaaacttaagatcagtgcttgagatattttgcaaaccctgcactcagtggatcagctgacaccacccagactggtaacttggctcccagttctgccatcccacccaggaacagaagaccacaaaaaaacctcacttcgaccccctatgataccatctccaacctgaccaatcagcaccacttcctgagccgctacccaccaaattatctctaaaaactctgatccccaaatgctccaggaaggctgatttgaataataataaaactcaggtctcccgcacacgtggctccgtgtgaattactgtttttccactgcagttcccccatcttgctaaattggctctgtctaggcagggggccaggtgaacccattggatggtatatttctcaagagtcaaatattaataggtttaacatgtaagacttacatatgtgtgtgtgtgtgtgtgtgtgtttacatatacatatatttcaatagcttttggggttcaagtggtttttggttacatggatgaattataaattatatagtggtaaagtctaagattttagtacctgtcacctgagtagtgtacactgtacccaatatgtagtttttgtatccttcattcccttttcatcctctcctcttctgagtctccagtgtccattatatcactctgtatgcctttatgtacctatggcttagttcccacttataagtgagcatatatggtatttggttttccatccctgagttatttcacttagaataatggcctccagctccatccaagttgctgcaatgacattattatatcattattttttcatggctgagtagtattccatggtgtatatgtaccacacattttctttatccactcattggtcgatgggcacttaggttggtttcatatcttgacagttgtgaatcctaaattttacgtgcaaggttttgcatctgtagaggaagacaggattctcagtgcatgtgccaatttttgggttttccacttgagaatcttcaccagttttctcttcagaatcaaattcctgactatctggtgcttcagagttatccagaggttcatcattcagtctctgggttgcctctgtcatatactgtactctgccgcttttgccaattgtttactctccttttccaagtggtcaatttcattgttctttcttcaatttctctgtgaagcctctcattttccttaagtgtttcatagagggtgttcctttgttctgctacttctctccaatattgaggggataaatttcatttaatcctaaaatcaaatgcttcttgggtgactcctccaagattttaattgtcactctattctgggacaatgacaactctagagtgggaagtcctggctgtcaactggtcattccaatgcttcctcttggatatgctttgggccagtcacttttttttttttttttttttccgacaagagatctggctgtggaaggatgaatcatcttcagagttcttcttggggagaaactgttctttacatctttgattcctccttgtttctactttatcctaggattcattatacagctggtaaagcacaaaagatgggaggagaggattaatgatcatagtgaattcaggtgactgtggcacagccaacctacattgatccccactgtcgctggagtggctggggcacactgctgaaaagacttactcctcttgaacatactcctttgagtagtttttatatatgtaattttgcatatttttttcattttttttattattatactttaagttttagggtacacgtgcacaacgtgcaggttagttacgtatgtatacatgtgccatgttggtgtgctgcacccattaactcgtcatttagcattaggtatacttttaatcgtagtgccatacaattgtattgcattttccatttatagcatattataattattttgacttttattatgaaactttcaaacagaaaagtagatagtataataaaataaaataaaaagtatatatataacaagtatgtcggctgggtgtggtggctcatgcctttaatcccagcactttgggaggctgaggcaggcagatcacttgaggtcaggagttcgagaccagcctggccaacatggtgaaatgctatctctactaaaaataaaaaaaaattagctgggtttggtggtgggtgcctgtaatcccacctactcaagaggctgaggcaggggaatcacttgaacctgggaggtggaggttgcagtgagccaagatcatgccactgcactccagcctgggcaacagagcaagactccatctaagaaaaaaattatatatataacaagtatgtaaacaaaatacataagtaaaaggtagaataaaaaaagatagcataatacacacccatgtatttattgcttagaattaacactaatattatattttctttgtgcattttttttcttaagtggttcaaaagaaagtacagacatcatgatattaaaccctaaatcagtggctctcaactgaggttgactttgacccttgtcctccgcaagaggacttttggcactgtctggagacaatgttggttgtcacaaaaggaagcatgcctgcatccctggtagagatcagggatgttactaaacatgctacaatgcacaggactgccccctccaaaacaaagaattatctggttctaaatgccggtagtgctgaggttgaaaacctttggtctaaatgattaagaatgcgtttcttaaaatgcaaaatttcacataaccacatagcaccatcacttctaacaaagagaaaaataactctttaaaattgtctaataaccagtccatgtttccccaccattccactaaaatgttttttacagctggttttagcaaacactttccattttattagcactgttaatagaatctcactctaaatgactacagaatagtctgttaaatggattccctgaaatttattcaaaggatctatttttggatattagttttgcttccaggttttagacaaattatatttttgtaaataatgagagtttacttcttttctaactttgtgccttttctttcttttatttgccttatgttctggctaaaaacttcagtaaatactgaacacagcatatgagagtgggcatccttttgttgttccagattttaggagaaaaagatttaatattttattaagtatgatattaactgtaggtttttaaagatgaacgttatcatattggagatggtcccatctattcctagtttcactgagcgtttttatcataaagaactaatgatttctgtcaaattttttttctgtgtattttgaaacgatcaaatggttttcaaactcttactctgttatagtatgatgaattatattgattgattttcattaaaccaaccttgctttcttggaataaaccttgcttggtcatgatgtattattctttatatgtatgtataaatatatatctatagatacatatacatatatacatatatctatctatatatatagatatgtatacatatatatatagagagagctggattctgtttgcaaatatttggtttagaatttttgtgcctatgggctgggcgcggtggctcacacctgtaatcccagcactttgggaggccaaagagggcagatcacgaagtcaggagtttgaaaccaacctcaccaacatggtgaaaccccgtttatactaaaaatacaaaatttagctgggcgtgttggtgggtgcctgtaatcccagctacttgggaggctgagtcaggagagtcgcttgaaaccggaagggggaggttacagtgagtcgagattgtgccactgtgctcctgcctgggcaacaagagtgaaattccgtgtcaaaaaaaaaaaagaatttttgtgcctatgttcgtgagggattaggctgttattttttttacttgtaatagctttgttatattttggggtcagggtgatgctggccttctatattaaattgggaagtgatacctcttcctctatgttccgaatttgtgcattattgatatttctcccttacatgttttgtagaatttactaatgaaccatatatgtggaaaattttctttttagaaaggttttacaaatttaatttctttaatagccatggggttatttattttctgtgtcttcagttgttagtaatttgtgatttggattaattaatataagttgttgaattgttagaatgttttaatatttatcctttttaacatttttagaatatgtagtgctgtttcatttttatttatgtgggcaatttgtgctttccctcttttttttgtccattgttgttaagactttgtattgccactttactattagtatttcctttcttttacttgctttagatttaccttattcttctttttctagcttcttaagatggaaggttgtatatacctttcttctccagtgtaagtatttaaagtcataaattttcttctaagcactgcgttagctttatttcacaaattttgatatattttcatattattcagttcaaaatattttacagtttcctttatgatttcttttttgatctatgggttatttaggagagggttgttttattgcccaatacataggggatttgctagatatcttattgtgaatgattttattctatcgtgttactctgtatgatttcattctttgatattcattaatacttttatatgatccagaatatggtctattttactgaatgttccatgacaactttaaaagaatgagttttctgcagctgttggatgtagtagtttaaaatattatgtcagtttggtttacagagttgttcaaatagtgtttactgaatctttgatctgcttgttctatcagttataagttgagcatccctaatttgaaaatctgaaatctggaatgctccaaaatctaaaactttttgagtgctcagagtaaatgctcattggatttggagcttcatattaggaatgctcaaccagtaagtataatgcaaatattccaaaatctggaaaaatccaaaatccttctggtctcaagcattctggataagggatgttcaacctgcaccaagagggtttacattctccaactatgattgtgaatttttttttatttctcctttcagttctgtcagtttttcctttgtgagttttggaaatgtgttgttaggtacatctatattcatgattgttttcttctcaattatcctttttttattattttgaggtattcttcttaatatccagtcatactctttgtttaaatgctacattgtctgatattaacatagtcataccagatttcttatttttggtgttttcatactgtatctttttctttccttttactttctattggcctgtatctttataataaaattgtgtttctcaaaaacaacctatagttgggtgttgcctttcatatccaatttactaagctctgactttttcttagaggagttagtccatttacatttaaggtaattattgatatgattcgacttatgtctcccatcttggtatttgttttatatttatggtatttattctttattcctttgttcatttttgtcttttcaggggaaaattaagtattcttaatattacttttatatcctctgtggatagttagattatatttcctttttaaaaaatttagtggttactatagaaactacatgtaaatgttcacagtataccttcaaacaatgtttaacctaattcacagtataaaaatcatgctgcagtataattccacttatgtccaatcctgccttttgtgctcttgttatattctgtgttacagtgacacatatggtattaatcctatcatacgttgttattatttccagtctacactgtaaatagtcacttaaatatttgagaaattataaatgtaaaaataaaagtcaaaaaaggtcttttccatttatacaaatatttaccttttctggtgtttttaattcctttctgcacatctggggttccatctgatataatttccctcagcctgaagtatcagcaagtatctcagattttgtctctctaaggatatctttatttcatcttcattttgaaggatattttttgctagacatagaattctctgcttccatttcttttttcttgtcatactcaatgatgtcatttaattgttttctggctttattctagattctgatgaaaagttagccatcataaatttttttctaatgtatttaatgtgtcattttattcctattgctttttagatttgctgtttattgttttatgtgatttttggttgttaaatagctaggtaaggttttctttatatttatcttgcttagggttcactgagcttcttggctctacaggtttatgtctttcatccattttggaatgttctcagatggttattattatatcaaatatattatctatccagtttttctcttctctttctggaacttctattacatcacttgatatcatgttagattcatttatactgtccaacagatcttgaatattctgttgtattttttccactatttttgccttttgtgtttcagtttggatactttctattgatctgccttttgtccctgatgctttcatctgttttttttccagtgtgctgttaagcacatctgatgttattgatttctaatattgtatttttcattgctacttatcccatttgattttcttctaacatttcctggtgaacatgtctttaggaaattttccatttcttcatgcatgttatctatatttttcgttaggcttttggcatttttattatagttattttaaattccctgtctaataattccaacatctgagtcatctgtggatctgtttttcttgattgtttctactcttaactataggccacttttttgttgttctttaaaaaaatattaatacgtcttctaatgtttgattgtatactgaaaattctgtataaaagaacagtagagactaaagtaaaaaatatttacatccaaaagagcatgcttttgataagacctgtagtaaatctctcctctcctctaaaatgatcttcactttgtggaatttagttcatttggatttttctgtgtccttagttcactgaaggttttcttttttccaaatagctttgtagctcatctaatttgttttgattatttgcatgagaatggcattttctgttgactttctatttctgaattcaaagtagtatgcaaccaaatatgcttcaacaaagatgtgcattcaccaaatatttttttaaaaatttacaataatttccttaacataaattctagaaggtagacattgatcaaaatatctaaagattttttatggttcttaataaaatatggtcatattacatctcaaaaaaacaaggaagttatacctatttttaatgagtgcaaataaccattttgcttcataagctttaagtgttataattaatttgactttgctaacttattcaaaaaatattatttcatattacatacctttaacttcaagcactgtacaggatcaaaatcttatgttcattttttagcaggactgactttacctggagaataagtgaacccattaaacatcagaattgtttgagtagatagatggtaatgactgatatttattgagtgctttttatgaaaaaagtggtgttttaattctcacagtgacctgtgaagaaggttatcatttcatcactccagaaggagggtttattccctacagaggagaaaagagaggctctgatataatgggacaggattaaattcaggagaatctgagccccaaacctcagtcttccaactttgatgtgatttaaatcatatctgaatgcaaccaatattgctatctgtattagtcagctgttgctacaataatgccatataacaaacaccccctaaactcacacttaaaacaatagttttgtattctcattgagctgcagtttggcagtagaagttttgctttaaaactcccctcttagtcatttattgaagaaaaacataatgaatacctcttattttccaagcactcttctgggctctggagaaacaacaatgaataaaatacacataaatgctgcccttaggaaacttactttcttgagggaagagacatacagtaaataagtagactatatagtaagtaagatgctgataatttctttattttgtttatttttctttttctaaattggtttcctcagattgaagataatttctttctttttttttttttgagacggagtctcgctctgtcgcccaggccggactgcggactgcagtgggcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgataatttatttcttttgtttttttttttgagacggagtctcgctcggtcgctagactggagtgcagtagcgcaatctcggctcactgtgacctctgcctcttgggttcaagcgattctcctgcctcagcctcctgagtagctgggactacaggtgcacacaccactacacccagctaatttttctatttttagtagagacaaggtttcatcatgttggccaggatggtcttgatctcttgaccttgtcatctgcccgccttggcctcccaaagtgctgggactacaggtgagagccacagtgctcggccagattaatttctaatgacagctataaagcagtggaagaggagaggacgggctgtcaggtgaagaacagcaacagggattgctgttgcaatgtgctttctcttatcactgcgcttcctagcataccgccaaaccctggcatctctgttcatttttacaatgcagagctatttcactacttctttgtttcactgtcttcttctaaactgtgccctggggggcctcacatttcataaccaaagctgcctatcaaagtgttttgctaaagaaaatatatttagtctggagagaaataatgtctctcccttagggacagaagcagctgcagtcagtagtagttttagatagcatttttctcctctgtcacgcagcattgcaatctcttctttatttaaaagttgaaggtcagaggtgaagatgtgtggaaacttactgaggaaaggagacatttgcagagcacccactatgtgctagatctggtgcaagcagatgtcttcaaataatccttgaattagacattatgattcccattttcctaatgcaaaaactgagctgtatgcaggcaaaataatccactctcggacacaaaaccagcagttgcagatctaagttttaattcttgagtgtgtccttccagcctcctcccaaccaccttcttgttgctttggattggatgtagagagctgcttattttataatctttgtggctagacctggaatgctggctttgtgtttctgggcctctctcccgcttcatggctagtctgtgtggtatagcccaactgctgccccagtaataggaggaggcagtcaggtctggggggaaatgaaagaattcccagggcacccggcaaatgaatgaattccactgatcttgtttggttccttatgggatcatccatcatgatttaacaacttgcagcccagggtaactacaggcatgcttcttgcccaaagccacagacacagtgtaattcatggctgaaaaacagatttgtttttctgttattattacctgtatcatgcccattatactatattatatgctgtgttatcatgtaatttagtcctctgtctgccgcattgacgtttgcttttgagaagactcggcttttctcattcttttgtaatgcactaaagtaaacaaattccctggctgtaatgtaagcagatatttgttgagggcccactgtgtgtacagtagatgggatacagaaaagctctggttttgctcaggaaacttaccctcctattgttttctgcatttaattttatttttaatttttttctgaggcagagtctcactctgttgcccaggctggagtgccctggcatgatctcggctcactgcaacctctgctgcctgggttcaggccattctcctgcctcagcctcctgaggagctgggattacgggcaccggccatcacacctggctaattttttttttttttttttgtatttttagtaaagacggagtttcgccatgttggccagcctggtcttgaactcctgacctcatgccatctacctgccttggcctcccaaagtactgggattacaggcgtgagccaccatgcctggcctatttttaaattttttaatgcaatatttgaaacacagaaataatatatatatataacatgtaagttatcaaacatatcaacaaaatgaagacccataaaatcattgctgtcttagtccatttgtgttgctataaaggaatacttgagactgggcactttattttaaaaagcagtttatttggtgtatggttctgcagtctgtacaagaagcctgacactgcatctgcttctggtggggcctcaagctgtttccacttagggcagaaggggaagtggagggactgtgcacagatgacgtggtgagagaggaagcgagagagagaggaggagatgccaggctcttttcagcaactagttctcctgggactaagaatgagaacttttttttttttgagacaggatatccctttgttgcccaggctggagggcagtggcatgatcttggctcactgcagcctccacctcccaggttcaagtgattcttgtgcctcagtctcctgagtagctgggactataggcgcctaccaccacgccctgctaatttttgtatttttagtggaggcagaggttcttcatgttggccaggctggtctggaactcctggtctcatgtgatcctcccgcctctgcctgccaaagtgctgggattacaggcatgatccactgcacccagcccaaaatgagaactcacttctttgagaatggcaacaagtcattcatgagcaatcaactcccatgccccaaacacctcccaataggtcccacctccaacatggggagagatttcaacacgatgtttggaggatcaaatatccaaactacattaagtgcctaactgattgactaaaatgaccagttctactggatccatctgggtggaaagtgcctcttgcatcccccatcctatccccatgtggaaatctacaatcctgttttgtgtttatcatcccctttctttgctttgttagctttaccacaaagctttatcagttttgcttgcttttgagctttataaagatggtctcataccttaaataatttttttttttttttgagacagagtcttgttctgttgcccaggctggagtgcagtggcacgatcttggctcaccgcaacctccacctcccaggtccaagtgattctcctgcctcagcctcctgagtagctgggattataggcatgtgccaccatgcctggctgatttttgtatttttagtagagacgaggtttcaccatgttggtcaggctggtctcgaactcctgaccttgtgatctgcctgccttggccacccaaagtgctgggattataggtgcgagtcactgtgcctggccttaaataatattttaagacttgctttgttcacactatatggtttctaagatttattccatttttcttcatgcttcttttctttcttttctttaaattgaggttttttgtttgtttttgttttgttttcaaactctgcttttccctttacttgttggaattttaaaattccaaattcaaatattaagattctaaaaattctaaaattccaaaaatttaaaacctcttttctatcatctctcccttgaaattttattgtgtgtatcaaggaaaattgaaagcccataaatatcttaacttccccttccaaatactgtaaggactttatgatactttaatgtcaatgacttccccattacttaaatgtcaatgttgtcagtagtttcaatctcatcttaaattctcacaaatcagattgttactattaatattttatatagataatgttttagatttatctcctagtttgtaagcttacttgctaactattcttcttacactcgaaatttttttttctgggctatttttttttttttttttttagtattcttttagtgggaatttatcggtggtaaaaatctctcagtttttgtttatatggaagtgtcatcatttcacactcattcttaaaagacacatttgcctgaagcgcaattctagaatgatggttgttttcttttagaattttggagatgttattccagagtcttttggcttctgttgctttgcctgaaaactcaggtgatgatctaaatgtagtgtttttgaaggttatctgcccctttcccctgtgagcttttaagtcttctctgtctttgatgttctgtggtttcactgcaatatgtctagctatgaatttctttgcattcatcttgcttatatatgctgtgcttggacctgaagattttatgtgtgtgtttgtgtatatgattatctatctatctatctatctatctatctatctatctatctcatcatgcctcacttaacaatcgggatatgttctgagaaatgagtcattaggtgatttcatcattgtgtgcatatcatagtgtccttatacaaacctagatagtgtagcctcctacacacctaggctatatggtatagcctatggctcctaggctacatgactgtacagcatgttactctactgaatactataggcagttggaacacaatggtaaacctttgtctgcctaaacatatctaaacatagaaaaggtccagtaaaaatacagtattacaattttgtggagccactgatgtatgcagtctgttgaccaaaatgttatgtggtacgtgactgtattttaccatttttacaacatttctttccccctcccctcccttcccctcccctcctctcctttctctctcggacagagtcttactctgtcatccaggctggagtgcaatgacgcagtcttggctcactgcaacctccgcctcctgggttcaagcgattctcctgcctcagcctcctgagtagctgggactacaggcatgtgccaccgtggccggctaatttttgtatttttagtagagacagggtttcaccatgttggccaggctggtctcaaacttctgacctcaggtgatctacccacttctgcctcccaaagtgctgggattacaggcatgagccaccctgcccagcctttgcaaaatttctatctattatcacttttaatattgcctcttatccagtctctctattctctcctaatattatgtctaatatattagacatacattagtctgtttctttctgtcctctgtatctcctaacttctctttaatagttttaatcacctaatctatttgtgttgttgcaccctagataatttctttagacatatcttcaatttctaattctctttcctgctatttttaatctgaattgagtttttattttatttttcttttttgttatatatatatttttgagacagattctcactctgtcacccaagctagagtgcagtggcacgatcctggctcactgcaacctccacctcctgggttcaagcgattcttgtgcctcagcctcctcagtagctgggattatagacctgcgtcaccaggcccagctaattgaattgagttttttacttcgacagttatatatttgatttccaaaatttttatttgaccatttttcaactatacctcataatttttttataaacgttgattattttcccatttttctaattccatcttttatttgtttaaatattttaatcagaattattttatattatgtatctgattatttcaatggttccaatatctgaagtttgtgggagtaaaaatttgttgtttattaattctgctgattctcactcatggtggcttatttcctaatgagtttggtggcttttgattataagctcacagaggcttgatcttaatctatggaaattcttatgacccaagtagaaaatgctttcacacagggagaattttcatttgcctccattaggagcctgggacaccaccagcattgtcttccttcaaaataactagccttacatgggagtctcagattccccaaccttgtcacagtcagtgactagttgttaatttaatcataatcacttgatgtatttttttaatgtcacacactgtccggtgtgttccacaaacattatttctaacttgcaaaataatcttgtaaaccacttcactgttgaggagataaaagctgggggaggccttccacacaatctgcttctcacaattctcctacacttctacaccatctctgcccatcaaaatccctcccctccttctacaccgtcctcaaatgctgcctcctcagggacactattcttgagccacaaagctgagcttaggcttttgctcctgtttatttgtttgttttttgagacagagtctcactctgtcacccaggctggagtgcattggtgtgatctcacgtcactgcaacctccgcctcccaggttcaagtgattctcctgcctcaacctccctcccaagtagctgggattacaggtgcctgccaccacacctggctaactttttttgtattttcagtagagatggggtttcactatgttggccaggctggtctcaaacccctgacctcaggtgatccgtctgccttggcctcccaaagtgctgggattacaggcgtgagccaccgtttgttcctagaacacataatttatatcggtgattcaagtaatcatcccatttcacagatgaagcatttgaggccctggagtttcatttgtaggcatttgtgcggatctacctaaaatgtcatctggctgcaaggccatcgcttcagtgttatttttgcatttatccttctccatccctcctaggcaacccctagttccttaccttcctcatatacatacagaatgcaagactaagaggaaggattccaaaaagttggatacattaaatttaggtggagagatgaggaacatatggagaacaggccatcagcttagtgattgtcaggcgattcctgtcatcaatatgtacccccgtggcccatgttaagtcccttactcattgggactgccctggtcctccgttgacctcaggtaaacaatcatttaagtgggattttattcaaaaattgcacttagagtggttttagtgggtcacattggctcttccatgaattctttgcgtctttttaagccagatctttggcattttatcaatctttgctttggcatcacgtttgaggatatattcaggggattttttttatttttaaaaaaactcttttgtttattgacagaaatagcatttctactaatacctcaagagcaagtactatcatgaatttaaattatttttccccaaatttaatcaagagtacttgagttaccagcttccaggttggccagaagtcctgaattaccttattgagactttctgctccagttccagggttcttgtataattaggagtcctcacaacttgtactcccaattagggaaaagcgctggtatttgtcagcctgtttgggtttcctactgagagaagatggcactgttgaacacggagccagtgctgctgggctacaatgtagtgcgggctggtaactctcacggtaacccctcttagaggtcctgttctggatgaggtttgtttatccactcaccacggtccccacaactccaatgccttttccaatgacagcaggtgaatgagacctacccaggatcaggccatttttactttcagcccctgagagagaaaagaaattaatttggttctcttttctgaacaatagagatttattcgttctaaaaattctacaaaccatatccagcaggcaaagaatgcctggactttagataaaccaaaagggcagtcatcctttgtggcagagtgctaatttttctccagtatttattttctccttcattttgttagcagtagaacttctcaagctttcactctgtatgtgaccatctgggtagagactacctttcttagcttctcttgcaactgtgtgtggacacgcaactaaattactgcctccagggtgtgagcagaacggatgcgtgcagcttcaagtcacagcactggaaaggaaaatacttgcctttcattctctatttcctctttctacacgttggaatttgacggagttctggcaagtctacttcaaccatgtggatgaggacaatacttcagaggaaagaagaacattaaaatgcaaggaaccagatccctagatgactgattgcaaggggcaaagaaactatggcagccctagactatgtacctctggaccaatctgtgaaagagaagtagattcctacttggcctgagtcactgtgtttttggatctcttgtaccagcaactcagccagtgtcctaaataacatgcatcctccctagtgggactggagagcttataggttcagtctcactgatgatccaacctctttagagcaggcaagaggaatttcatgtacctcttgataaagcggtaagcaaaacacaaattcagtgggacactccactgcaggtgattttgaggttctgcagtctgtctatcaagttaaatgagaaaaaagaagatagaggatcctggctgcataatcacacatgcacggaaggcaaaatcatttggacgggagccttgagtggtggagaaagcaagggctctgagccagatatttcagagttcacatcagtgtgtctttataatttagttgtttaagtcactactttctcatctgcaaaatgggaattgcaatgcatatttcatgtacttgttccaggaactaaatgagataatctatttaaaggtcctggcacagggtctggtaaaaattaggtgttaagtgaaagtaagttcccttccaatgtctgggcttttgatcattgcaccaagctgcctctgcaaggcacacaagactctaggtgatctgattcctccctttttcaccccttcagcttcatctggggccacttttcccttgcccatgactctctgactcctaagcccatgactagtttcccttcagtaccaaagccattctaaattctctcctgcctctggatcttcatacttccttttccttctgcttgcaaccctttctcatgatcacatttcagagaagccctcctgaggaccacgctatctaaagtagtttcttgtccactgtgttcagcagaataatgacaccccgcaaagatgtggtttttatgaagacagaaacatctgtcttatttaccagctcacctgctacagtatggattatgtagcacatactcaatatttattgaatgcatatatgaatgaaaaattgaatgggaactttgaaattcatcctcatccctggaacccaagagtatgttaagtgacatggcaaagggcaattaaggcagcaggcgaaattaagtttactaatcagctgaccttagggagctattcctggaatatctggttggacccaaaggaatcataaagatctttaaaagtggaagagaggggcagaatcgaagagtcaaaggtaggagtgtgatgacggaaacaggtatgttactgcccttgaagatggaggaaggggccacaagccaaagaaagcaggcagcctttagaagctggaaaaagcaagaaaatggatgttctctagagcttccagaaggagcagccctgctgacatcttgatctttgcccagtgccttgatttcagctcagtaattttagcccatgttggacttctgaagtacagaactgtaagataatacgtttgtattgttttaagccactaaatttgtggtaacttgttccagcaacaataagaaactaatatacctgtatgccagcccagtatctaatatatatatatcgccctctttatttgctgcctaacactcagcacgatctgcaattatcttatccatttatgtgtcctcttgacttagtcaaatggggcttttatgaagacacaaatgtctatcttatttaccagctcacctgctagagtacgggttatgtagcacatactccttctttattcatttattaattatactttaagttctggggtacgtgtgcagaacgtgcaggtttgttacgtaggtatatacgtgccatggtggtttgctgcacctatcaaccacactaagtatttctcctaatgctctccctcccctagccccccaccccaccaacaggccctggtgtgtgatgttcccctccctgtgtccatgtgttctcattgttcagttcccacttgtgagtgagaacatgtggtatttggtcttctgtgcttgtgttagtttgttgagaatgatggtttccagcttcatccatgtccctgcaaaggacatgaattcctccatttttatagctgcatagtattccatagtgtatatgtgtcacatttctttatccagtctatcactgatgggcatttgggttggttccaagtctttactgttgtgaccagtgccgcaataaacatacatgggcgtgtgtctttatagtagaatgactccatatttttttaatgcatgcatgaatgaaaaattgaatggaaactttgacattcattttcttcatctgcagggcttgtttctgagagtgtgcacggagattgaagggcaggggctcatgtgacagtgtgaagcaggaattctgaccgttggccaaaccaagccctgaaactcaagttctgtttgggagtgagaggcaggttagaggagataaacacccagccttttaattttttttttccagcctgctttaaatcacctgtaaatctttagtggccaccaggaggtgaatgactcatgctaccttttctcagcaaaggctcttcaggatgggacactccaagtttttaactcccagcaacagttcggctcacagcgagaccgggccctctgctgtcactgaagtgtgtgtttgtttaattagggcgccgagtagagcctcatcctggtggcagatgttgccatgtgtagtataataaataaaagtctttataggacccagcaggcagtagagccttcagttagcagatggcgaaatattaaactggcagagcaataacttaactgcctgaatcagctggtccctgcccggatttgctccaacatgaatcaacttcatataggaggtgtcgctcagcctcagatgtgtaccctcacctgccctcgctcctggtccctgctaggaccatgtttgccttggcataccactattaaagtcagattactgggtttaataccattattaaagtcagatacataagtttttttataaccttattagctggtcaaagagaggtgcttgctgggctggaccgtagggttcttttacaggggaaggaaatgcagtaagcctgtggatgtcctctgtgccagtttctgcttggctccagattagccagacagtatgttacctggcccctgggccctcgtggtgcaggagaaggatcccacttggctccaggaatcctcctgtttaagaccaggaggatggttcagttagcccagggagaccccactggaggagagaacagggctttttgttctgaaaagacccaaaaaagggattgactgacatctattacattgctgcaggggtggagtgaggggcattggacttgtttactaaattccagattatacgactgatatttacagagggcttgctatgtgttgggactttggataagggctttgcagacgaacagaaacccaccccatctttaccataaccctgtgaggcagtaacaacgaacccttctagcgctgtgtgccaggccccgttccaagagcttaatgtacattgactcactcaactccccaacatgaaacattaaacccatttctcacatggggaagctgaggctctgagaggtgtgatgatttgttcaaaaacacacagctagaagataccggagctaagatgcaacccaattgtgtctaaactcagaggcggcagttgcctttgactccaggaggcataaaagtaaacttggacagaagatggtgaacccgtaggcaaaatgccacctagaaaatgaagtggggaactgatactaggaaagaggatataaaatttatatttgttgccatttattgccataaattcggctactttttaacagatatctgaaataattttctcctttaattcttacagaaagccttggaggcagcttcaattagaagctaattttactaattagaaaattggtatcagaaggacgattgaacgtgtccaaggtcacacagccagtaaggagaggggcctggactggagcagacctgtctgattcactcagacaggactggagcagacccttgctttgttcactcaatagttttttccaaaggctttttaagaagaggactttggagttgtaaagaatttagatacgtggaaatgagagaaaggccttccaggcagaggaaacaggatgaacaaagtcttggcaggtatggacaactctgtgtgtgtgtgtgtgtgtgtgtgtgtgtgtgtgtaggtaggtaggttggttgttggagacagacccagggaagccttgaatggcatgctgaaagaattggtctttctgcccgggcttggtggctcatgcctgtaatcccagcactttgggaggccgaggcaggcagatcacttgaggtcaggagttcgagaccagcctggccaacatggtgaaatcctgtctgtactaaaattacaaaaatatcagcccagcatggtggtgcagggttgcattctcagctactcgtgaggctgaggcaggagaattgcttgaaccccggaggcagaggttgcagtgagcagagatcatgccactgtactccagcctgggcaatagagggagactccatttcaaaaaaaaaaaaaaaaaaaaaaaggtgcttctttctctggcaaaggaggatgctcaagttttctaagtcaataattaagctcatgcaaacaaagggccctttctgatcaccatggtgggtttccactgcctgcttctccgctaacttctataacgaaaatgatactcaagacttttcttgccatcatggtcaataatgtgagggtttgagcacatcctcagagttaggctttggaatttcttgaattcctgctgtgtggggcgtgctggggagtctttggtctgagggctggctgctgctcgctttggccctttgatctcccagtgcccgggatctttcagtctagcttttcctgtgtcctgcattgccagtccccccaccctctggatctgtcccctttttgttgtctctgagctaatgggacagattccatggatgctggcctggacctctctttcttcagcctgtctcatgacctctaaggcctggcctgaggaggaggcataactctaggaggtcgaggtgagcctggcgctgcaagtatgcccctaatttgtgaaaccacagtcatagatatcacagttggttaatacactcgtccttggattctttcaaattcattgctcctgttcaaaaaacatttctctttttttcttattgcagtagtaatacatgcttattgtatgttatgaagaagatgcagaaaaatataagtgatgaaacgatagcccataataatcccacaaccccaagacaatcattattaaccttgggtatattttcttacagtcattcatacagacgtatacaaaacacacgtctgtctatatgaaatacttacgtgcttaaactcataccagatatatgattttgcattccatgtttccactcttataaaatcagtgcaatttttttacattgctaaacttctttgtaaaaatttatatagaaaaacactgtaggccaggcacggtggctcatgcctgtaatcctagcactttgggaggctgaggcgggtggatcacctgaggtcaggagatcgagaccatcttggccaacatggtgaaaccctgtctctactaaaatatgaaaaattagccgggcatggtggcacttgcctgtaattctagctacttgggaggctgaggcaggggaattgcttgaacccgggaggtgaaggttgcagtgagctgagatcacaccactgcactccagtctggtgacagagcaagactccatctcaaaacaaacaaaacaccataaaacaatattaaagggaaaaaagcagaatttgaattcatatgtttaatataatttcaattatgttagctaaaaacacatgggtacacgatgcctatgcactacaaaagtaccacacaggatggaagcagagactacaaaatattaatagaggttatctctaggggatgtgttttattttattcttgcatctttccatgttttccacgtttttcccacatattaatcatgaatttttctaatgagaaaattttgcatagctacataatagtccaagatatgaatataccattgtttatttaattattggcctactaaaggcctttgggtagtttcaaagcttttacatttataaataatgttgtgttaaatgttcctttatctgttcaacagatatttgagagtctatggcatgccttgtatcttggtgcctatatctgcatatgttatataaataatattttatttttgtggaaactgaagagcaaagaaatcaccgagttagttggggacacggatgggtctgtgcttttaggtctttcaattctgaggatttatctttgccagactgctttcctcaaacctctggtctccctttggcagaatggtggcaaattggaggttctcttgggtatattgagtcacagatctccttgaatagtgtgtgacactactcaagaagtacctacttggcccccagcctattgcctggtggcctccttcttgcagatgcacccattttgcagatgggtcaaagcatgtagtcttacagcacaaatacttgtctttgtggaaagtcatcctccctctgcttggctgctagactttcctgtgtgtccatcataggtgtggctttgtggcacccagtcaatctgattaagatggttcttgcttatcagcttggtgctatttgagatgatacattggaagtccacctcaaatatcacctcctccctgaaattatccagatactctcagacaaagttcacagctcttttttggatttttttttttttgtgtgtgtgtatggccttattttaaaaacatatctctccaaaccatggctgtgtctgtacatctttttctcatcaagtaggttattagctctttaaggtcagggaccacatgttatccactttggtaccctgtccatttgcttctgtttctcagtctagcgcttgccttcatctccactgccactattcaagtgcacaccttctatcaccacccacctagaacactgaaccagtgtccgacctgctgggactccctgcatctgctctcgtgccacttacaatccagttttcccatagcagtgaaagggattatttgaaatcacaaatcaaatgtgccatttctttccgtagctcagcaagatctggccctcgcctgcctctctgacatcatcccagtgaactcatccccattcctcacagcacttctctctgatcccttttatcacatcattctgcataacagtttggattattgcccagcaagtgttgatggcctccccgctccaattgtggatggtatttacttccctaccacatgattttgggcttggccatatgactcgttttggccaacaggatattagtgggtagaagtgaacagagatttgaaatgtgatagagtggttgggctcacctactttagttcttccatggccatgagggtaacatgccctgggtaacctgttggtcccagaagagtgagagatgcaaggaacagacatgaactaaacatatggcctggagccaagcccagcctagatcagccaaacccaggacaaaccatagttgcataaatgaggtacacatgcttgctgttgtggagttactggctgtatgctacccagcactgctgtggcatagttgactaacacaccctattttatgcacttcataattattattttgaactttccgtcttttctaatcaggacatagtttctatgataaaagagacattgcctattttgctctataattccagctatatatatgaaatcaccaataaatatgcatgtatgtgtgtatgtatgtatgtatttttgagacggagtcttgctctgtcgcccagtgacgcgatctcggctcactgcaacctctgcctcctgagttcaagtgattctcctgcttcagcctcccaagtagctgggactataggcacgtgcacctttttttatttttgtatgcctggctactttttgtatttttagtagaaatggggtttccccatgttagccaggttggtcttgatctcctgaccacgtgatctgccagccttggcctcccaaagtgctgggattacaggtgtgagccactgtgcctggcctgccaataaatatttattaaatgactgaatacccccggcatgcttagcacaatacctgtgcccgatcaatatttgctgaatgcagttggtgaaccatccaaagcagcctgtattgtgtcctaacatgtatatctttaaactcaacttggcacgtgggtgacacctctatcccctctcttcctctctctgatcacataaaagatcctccttgtaagaatacacacactgaaaacagatgatgtgtcaatgccgtaatttaaaccatgaatctgtacttgcttaaagatgaacttgtttggaagaaaaatgaggaaaatgcttgtgcccgtccaacagagtccccggataagtacatcaattttgcttcttagcggatccagcacataataaaagaaaactgctgaggtcagcagcagcagagaagccacacttcttattttcacaaacacagttttggggatggtaatcatatctattagcaagggtgacaccactgtgggcctggcagaaaaatgagctctcccgcattgcaaaatgagcaaagtggagatcgataaatcataaaattagttgagacatcatctatctttcatggctttccctttattcctgccacggtccctcaggacactcattcatttactgcattttattgttgggaaaacacgtcaaggtttggaggctgcattcagttaggggagcaggggccataatgtgtgtcattaattaggcaggtttgggaggttcaatccaaagtctggtctcaactgacttccataaattgagttttaggactgcttctgcgtcttgtgtgacttcatcaaaaagagaacgttattgaaatatgccctgagagggagagagagagaaagagggacatgtctgctcactctgtagaaacgataaatttagggacaaaccaggtgataagccagatgcaatctgagttgtctaaagattcttgctgttatctacatgtgattgaaataaatgtgagacacagagcttggagtgcatagatacgtcatctggtacctatattcttcatgtcaaggcatatagtaaacagattttttttcaaaaaattattgtgataacacttaacatgagacgtaccctcttaacaaattttaagtgcacaataccttgttgactctaggtacataatgtgcagcagagctctagaacgcattcatcttgcctgacggaaacttcacgcccattgatgagtagctcctcattttctcctccccacagccctggcaaccaccattacactcttttgttctacgcatttgactatttcacatgacccctgtaagtggaaataagaaatatttgtctttgtttgacagatatttaacttaccataaagtcctcaagatttaattcttgttctcacatcttgcagaattttctcctcctgctcctcctccccctcccacctcccccctccctcccttcccccccacttctcctcctcctcctcctcctccttctccttcttcctcttgttctgatggagtttcactcttgttgcccaggctgtagggcaacggtgcgatctctgctcaccgcaacctccgcctcctgcgttcaagcaattctcctgcctcagcctcccgagtagctgggattacaggcatgtgccaccatgcctggctaattttgtatttttagtagagatgggatttctccatgttggtcaggctggtcttgaactcctgacctcaggtgatccacccgccttggcctcccaaagtgctgggattacaggcgtgagccactgtgcccatcccaaattttattctttttgaaggctgaataatattccattgcgtgtatataccacattttctttacccattaatctgtcatttaggttttttccccattttggctgttgtgaacagtgctgcaatgaacatgttagtgctaatatttcttccacattctgattttaatttttatgggtataaatccagaagtaggattgctggatcatatgctagttctattttcaattttttgagaaacctccgtactgtttttcttagtggttgtaccattttgcattgccaataatagtgtgcaaaggtttcaatttttctacatcttcaccaacatttgttgtcttttgtctttttgacactagccaatctgacaggtgtgaggtgatttctcattgtggttttgatttgcaattagtgatactgattatttgtggtattggacattttttcataaacttgttggcttaactaaggaggtgaaagacttgtatactaaaaattataaaaccttgaaagaaacgaaagaaggtggcccggcatggtggctcatgcctgtaatcccagcactttgggaggctgaggtgggtggatcatgaggtcaggagtttgagaccattctggctaacatggtgaaaacccatctgtactaaaataaaaaaaattagccaggcatcatggtgcgtgcatgtagtcctagctactcgggaggctgaggcagaggaatcgcttgaatctgggaggcggaggttgcagtgagccaagatcacaccactgtattccagcctggtgacagagcgagcctttgtctcaaaagaaaaaaaaaaaaaaaagaaatgaaagaaggtataaacaaatggaaagacattccaaattcatggattggaagacttcatattgttcaagtgtccatactatgcaaagcaatatgcagattcaatgcaatccctattaaaatccaaaaggcatttttcacagaaatagaaaaaatgagtctaaaatttgtatagaaccacaaaaggccacaaatagccaaatcaaccttgagaaagaagaacagtgttggaagcatcacacttcctgatttcaaaatatattacaaggccacagtaattaaaactggtataaaataaaatatggtactggcataaagacagacatataggccaaaggaatacaatagcaagtccagaagtaaatctacacatatgtgatcaaatgatcttcaacaatggtgccaagaatatgtaataggggaatgattgtctctttaataagtgatgctgggaaaactggataaccacatgcaaaagaatgaaataggatccttatctaacaccatacatgaaaatcaactaaaaaaggactaaagacttacaagtaaaacctgaaactgtaaaactcctagaagaaaacataggggaaacacttcatgatgttggtcttgccaatgatttcgtgaatatgacaccaaaagcacagacaacaacaacaaaaataaatgatgagaactatgtaaaacgaaaaagtgtctgcacagcaaatgaaacaatcgagttaaaagacaacccacaaaatgggaaaaattatttgtagaccatctatgtaatgagttaatttctaaaatatataaggaatttctacaactcaatagcaaaaaaaaaaaaaaacctctaacaatctgattaaaaagtgggctaaggactttaatagacatttctctaaagaagatattaagtaggtttctaaaatcgtgatgtgtttttcatttgatgtgtgcatttaattgacgctcattactccatcaaaagcatcctgaaatcaaggaaacagtacttactagaatgtttcagtgatcgatttctgcctattaaaccaccccaaaacttaatgcattaagactaatttattattgctgtgattctgggacaaaacataactaactttttattcccctttcaaggtgtattttctgcagaacccccatctcagtaaatgccactatcatccactcccttgctcagctccttaaacttggagtcatccttgacatttttctttctctcatgcccctcatctagtttatccacaaattaccaagaaacacccacaagcctcctctcttcagcactacccccgtaatccaagccaccatcccatctcccttgggctattctggtagcctttataatcggtctcctgctttacctcttgccttattcagtctattcttcatatagaaaccagaatgatctttaaaataaatataatcagaggatgtcaacctccccaccacccggaccccacagcttatgactatccagcagctacctgttgtattcagaataagacccttataaaaccacttgctatagtctacaaaggccctgccctcctctcctcccttagctcatctctagccacactggccacactggccttccttctcccctttagcatgcatggacgtttacaccccagggcctttgcacctaatgtatgtgtgtgtgtatatatatatatatatatatatgtatatttgttgttgagaggaagtctcgctctgtcacccaggctggtgtgcagtggcgggatctcggctcactgcatgctccgccacccgggttcacaccattctcctgcctcagcctcccgagtagctgggactacgggctcctgcccccatgcccggctaatttttttgtatttttttagtagagatggggtttcaccgtgttagccaagatcgtctcgatctcctgacttcgtgatccgcccacctcggcctcccaaagtgctgggattacaggcgtgagccacccccacatccgcacctagggttcacaccgaaaaaaaatagtaggctctggagatgcaacagaccctgctttcattggagctttcagagagggaagacaagtgaacacatgaataaatgttaagaggtagtgagcattaaggagataaagtaggtatagagaatggagagagatgggaggtgtgaccccgtttcaatagggtggtgagtgaaggcctctctgaaaaggtggctttgagcaaacgcccaaataaatggaggggctgagccgtgcaggtatctggaagcaaatggggcaggggaaggagctgtttcaaaggatccaagatgggcaaatacctgcagggcttagaaatggtggctataatctgaaagcatgtagcaatagaagccttgcagctgaatacatgcatttgaggcagcaatgacttctttctagggggtttatgtgaggagggatttttctttttgggaaaaaccctgaggtacacgtattcaaaggaaatatttgttgacttggatggaaagggcctgtcttcagctttcgttctgctctgcctggctgcctctcagtgttaggttcaatgcttgaggctgtgccaagttgatttccctgtgagagcagacgcctgatagtagggcacagtgccagtcccgttgataatgaaatctttgcatccccgttgacacttctataaaggacagaagaggaactgtaagttcccattctgatcttttatttctgttttgtcaccctcaagaatacctgtcagaaagcttttgggatctggactcagatggacctgaatttgaagcccactgtgaattttactgcagtgggattttggtgagagctgctcaaacctgaacttgaggccaggcctggtggttcatgcctgtaatctcagcactttgggaggccgagacaggaggatcatttgaactcaggagttcaaggccaggctgggcaacatagggagatcctgtctgtaataaagaataaaaaattaaaaccctgaatttgagaggagcacgtggtgacagtgctcagatttgggttattcatgcccaatattgtggctctttctgtttttgttttcaaattttgttttatatttgtctttacagaacattaacattgttccaaactaataactaaataaaaaagccatcctcagagtaggtacagagtggttagttgccctggttggaggagtgggagagttctatcaccaatattgtttagaattgccagtaataataaaaatggatgacctttaattgctttttgttcatgtcataatactcgtgtatgaaattcatatatttttagaaataaccacgttgttttggaataattttagatttgcagaagttgcaaaaatagcacagataattcctatagttacccttcatccagttccccctaatgttagcatcttacatcaccatggtacatttgtcaaaagaaattaatattaatataacactattaactatagactttactcaaatttcatcagtttttccaccaatgtccttttttcctggatccaaaatttgatttagataccaaattgcatttaatagttgattgtattactgttttttaaattctctacagacaaggcacctattgactgcacctggcagaacaaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatgtgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcaacatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggcgtgtagggatgcctcagtcgcttacatgttgattgagtgaatcgtcggtttctttctggacactgacttcaaaaataaaataggatatgaaaatggctccatttgttgtcaccattttgtggggatcctatgtcctttgaagtggtcaggagtgggagaaacgtgataggggaagaaggagtggtgtggctgatggatttaacatgtgttcttttatgttggcaaggaagcggatgaccttaccccttgttcctcagatcctgtaaatggctttataacatgacccagggctgcttggtgtgggactagaccccagggtttgagggtctgaagacaatttaggttcgtgctggcaggatgtcttggctcagagacaagtatttctgtggggtgatcccagcatcctcccagcatactgctgctgttgctaggcagagaccccggagtggggagagggtgatagcatctggatcatccattcctacctaggtggttttggctcatagtaaaagggacctcagcacctatccgctgctcagcctcggagctgcaggtgtcagggatatcatgcactgtccaaaaagacatgcaaaacttaacacccgtgcattttcatggagagaccccgtggagcctctgaccagaggctgaaagaaatgtgtcattcaaaagaccagggaaccactgccaaggacccctacattcagcaacacatctatactcgtgcctgccacgtgtccgcacttagaggccattgtctcacctcagggtcaggagtgccaggtgaaagagcacacaggtctctgggcaaggcagagtttgaagctaggtctggaccaacgtctgagagtatgacttcaccccaggcgaggaagttcactttgagctcctggccagggagaaagcaagctctgggagacctaaactctgaatctcacttggcttttcagtctaatccgttgttgccaaagacatacttggcaatcccgaatcctcagagggctccatacgtgctgcgcttcagccttcgctcacggttcatcccacctggaatgcctttttctctccaaagatgttcccaagagccaagttaaatgtcacttccatttatcttcctccaaaaggaacatgtgttttacttcatctttctcctaaaaatgtggatgccttaatgagactaataatggttgttagtgcttgccaggcgtggagctaagagtgttacatatattatttaatctgagcaatcctgcatcatgggtactattaccagctccagtttttttgagacggagtccgttttgtcgcccaggctggagtgcagtggcatgagttcaagcgattcttatgctccagccttctgagtggctgggactaccagcacacatcaccacgcccggctaattttttttgtattttagtagagacagggtttcgccgtgttggccaggctggtcttgaactcccgtcctcaggtgacctgcccgcctcagcctcccaaagtcctggaattacaggcgtgagccactgcgcctggcccagctccagttgttcaggtgaaaaagatgaggcacagaattggaaagccatttgtccaagaggctaagaagtggtcacgtgagcatttaaatgtttttaagcctcagcctactcctctccaggcccttagcgtgtttcgtcctgcgttttcctggtctttcccagtgtttattagatgtctatagtgtccagacaatgttaggcagacgggacacaagggtgcacaaacaaacagtctgtgcccttattggaacctgttaatccctaaagggctaagcctccctacagcaagaaccctgttagtcacctgtgtatccccagcatctcgactctccacgggcatggcactatgctgtaaaaaaaataatccctgaccctcatggctatgggaaagcatgccttttaaagcataatccggctgggtgtggtggctcacgcctgtaaccccagcactttgggaggccgaggcaggtggatcacctgaggtcaggagtttgagactagcctggccaacatggtgaaaccccgtctttactaaaaatacaaaaatttgctgggcgtggtggcaggtgcctgtaatcccagctactcaggaggctgaggcaagagaaccgcttgaagcctggaggcagaggttgcagtgagctgagattgcgccattgcactccagcctgggtgacgagtgaaactccgtctaaaaaaaaaaaaaaaaaaaggataatccaatctaggtgcctctgcctcagtgttgcattcacagaattccgtggacccaaaaatcagtcttggaataggctgggatatggacaggacacccaggttctgcccctacacctatcccccacctggcttttttttttcttttccttgagacagtctggccctgtgagctgaggttgcaccactgcactccagcctgggcagcagagcaagactccatctctcaaaaaaacaaaaaacaaaaaaacaaaatggggttaagagaatgggctttggaatctagtggcttcactggttgcttgctgtgtgatctcgggccacttgctgtgcctctgtgcgtcagtttccttgtctttagtagagagatgatagtaacatttcctgtagtggttgtgaagattatacataatgtttgtaacctgctggagtggtcattagagctgttcaccaaatattcagattctccccggttggcacatggtgggagtgccttgtccatgtgactaactggccagtcagctgggagcagaagtgcctccttcaggcgggggcctttagtggctggcaggagacctctatggctcctctttcttttttttttttttaattaattttttttattatactttaagttttagggtacatgtgcacaacgtgcaggttcgttacatatgtatacatgtgccatgttggtgtgctgcacccagtaactcgtcatttacattaggtatatctccaaatgctatccctcccccctccccccaccccacaacattccccagagtgtgatgttccccttcctgtgtccatgtgttctcattgttcagttcccacctacaagtgagaacatgcggtgtttggttttttgtctttgcgatagtttactgagaatgatggtttccagcttcatccatgtccctacaaaggacatgaactcatccttttttatggctgcatagaattccatggtgtatatatgccacattttcttaatccagtctatcattgatggacatttggcttggttccaagtctttgctattgtgagtggtgccacaataaacatatgtgtgtatgtgtatttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgatggccattctaactggtgtgagatggtatctcattgtggttttgatttgcatttctctgatggccagtgatgatgagcatttttttcgtgtatcttttggctgcataaatgtcttcttttgagaagtgtctgttcatatcctttgcccacttttcgatggggttgtttgtttttttcttgtaaatttgtttgagttcattgtagattctggatattagccctttgtcagatgagtagattgcaaaaattttctcccattctgtaggttgcctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattaccaagtcaatcctaagccaaaagaacaaagctggaggcatcatgctgcctgacttcaaactgtactacaaggctacagtcaccaaaacagcatggtactgggaccaaaacagagatacagaccaatggaacagaacagagccctcagaaataatgccgcatatctacaaccatctgatctttgacaaacctgatgaaaacaagaaatggggaaaggattccctatttaatacatggtgctgggaaaactggttagccatgtgtagaaagctgaaactggatcccttctttacaccttacacaaaaattaattcaagatggattaaagacttaaatgttagacctgaaaccataaaaaccctagaagaaaacctaggcattaccattcaggacatagggatgggcaaggatttcatgtctaaaacaccaaaagcaatggcaacaaaagccaaaattgacaaatgggatctaattaaactaaagagcttctgcacagcaaaagaaactaccatcagagtggatatggctcctctttctttctgccatggtgatgggcgattatgcccaggagcggctgcttcatttgcctggcacaggagtgagggtgacaatgcagagatccagccacccagcaatgggtgtgtagcagcaagaaatgacccttttgtgaattaagcaactgcaatttggcgtttttataacctaacgtatcttgactgatacaaatgcttagagcaacctctgatatttagtaagggcttattcagtggcagaatagaaaagaatgggatctagagtaataaaagggattagccttctctttgtcagttagggatgtcaagagattatctgtagcaccctctgctgtcaacatgcctgtcttccatgaccagcctgtacccccctccctccacatgtttttgtttttcccagacagggtctcactctgtcacccaggctggagtgcaaatcgacctcctgggttcaagcgatcctcctgcctcactctccctagtagccgggactacaggcatgtaccaccatgcctaattttttattttttgtggagatgggacctcactattttgcctaggctggtctcaaactcctgggctcaagcaattctcctgcctctaccttccaaagtgctgggattataggtgtgagccattgtgcccagccacatggttcttcaatactcacccccaccccaaaccctctgacacatgcgtttagtcctggggtggggcacctgactcaacccaggttgaagatactttaggatattttgaacctgggagatgtgagggttgtctctttaaaatggtggaaattatgagatatttgggaacggcactactgatcctcctaatttatttttaattttttttttaggccgaggcgggtggatcacctgaggtcaagagttcgagactagcctggccaatatggtgaaaccttgtctgtactaaaactacaaaaattagcagggtggggtggcaggcgcctgtaatccgagctactcaggagactgggactacaggtgctcaccaccgcgcttggctaatttttgtatttttacaaagctttaaataaaaattgcttaaagctgaaaattgggtgggcgcagtggctcacgcctataatcctaccactttgggaggctgaggtggacagatcacttgagcccaggagttcgagatcagcttgggcaacgtgatgaaatacgatctctacaaaaaatacaaaaattagccaagcatagaggtacacacctgtagtcccagatactccactgaggtgggaggatcacctgagccgggggaggttgagggtgcagtgaggtgcgatcgcgccaatgcactccagcctgggtgacagagtgagatactgtctcaaaaaacataaaaataaaaaataaaagctgaaaaatttatatttaatattttgaaaacttaaatcttattgcatattattattaaataactttccagttctagtgttcaatgtcagtctaattgctcatctaaaggactgatattgcaacatacattttgtgtctcgatcttatatacaaattagagagtgatacaaattgtttaaatggctaaatgttcctcagctacagtgagtagccatattggtctcttttaaaaatttttattatttttatttaaacaaagttttaatttttttttgtagagacagggtctcattatgttgcccaggctggtcagccacaagtgatccttctgcctcagtctcccaaagttctgggattataggcatgaactaacacgcctgacccagattactctctaactcatgagtatgtctggaggcgcaatttggaacatgaagagaaacagaaaaatggactctcagtacttctgagaaatgatacttgttatacaagaatctactgcattcagcctccctgagaagaggaatttaagaattaatttctgcttcctcttacttaagtgtttcaacactcaagtcctttgcatactctgaagcaatgtgtgtctccaacattgggagcagctgcaacccacaaaccttcttgacataaaatagttgcattcattcattcatttatttgctctgccgcacaggctggaatggcagtggtacgatcttagcttaccgcaacctccacctccctggttcaagccattctcctgcctcagcttcccgagtagctgggattacaggtgcgcaccaccatgcccggctaatttttgtattttttagtagagacggggtttcaccatgttggccaggctggtctcaaactcctgacctcaactgatctgcctgcctcggcctcccaaagtgctgggattacaggcgtgagccaccacacctggccatagttgccttttgttttgagattttaggacaagagatgaatatgtttttttttttttttttttgagtcagagctttgctcttgttgcccaggctgcagtgcaatggcatgatctcgactcactgcaacctctgcttcccgggttcaagcaattcttctgcctcagcctcccgagtagctgggattacaggcatgcgccaccatgcccggttaattttgtatttttagtaaagatagggtttctccatgttggtcaggctggtctcgaactcccaacctcaggtgatctccctgcctcagcctccgaaagtgctgggataacaggcatgagccaccacgccgggcagaaatgagacatactttggggcctgaacagtgtttgttatgaaatggatgtttagggctgcagattgtgctgagccagtactgaacataagatcctgagtggacaggaacacctttgtggtcattagtgaatctgtttttaagagctgggagtggtggctaacacctgtaatcccagcattgtgggaggctagggtgggatgatcacttgaggccggagtttgagagcagcctgggtaacaaaacaagactctgtctctacaaaaaaggaaaaaattagctgggtgtggtggcatgagtctatagtcccagctactcaggaggctgaggtgggaggatcgcttgagcctaggaggtcaaggctgtagtgagttatgtttgtgccactgcactccagcctatttgagacagataatgtgtctcaaaaaaaaaaaaaagaaaaaaaaagaaaaaaaactcttggccgggtgcggtggctcacgactgtaatcccagcgctttgggaggccgaggcagctggatcacctgaggtcaggagtttgagaccagcctggccaacattggtgaaaccccttctctattaaaaatacaaaaatttgctgggcctggtggcacgcgcctgtaatcccagctactctggaggctgtgggaggagaatcacttgaagccgggaggcagaggttgcagtgagccgagatggcgccactgtacacactccagcctgagcaataagagcaaaactccatctcaaaaaaaaaaaaaaaaaaaagaaaagaaaagaataaaagaaaaatccattgaaaaaatcatacatttgtgagatggagagccaatcttgctaggaactgagggggttactggctgcaagggagatggggaaaacaagtcctggcctccacctaggggatctatagactcacagtgcaggaatttccccggagacagaggagcgctttaaaggtactgtgcggcccaaaatggtggagtagggaattccagggctccatccctcccccaacacaactaataaggtggcaaaaactgtcagaatcaacttctgaagtactctgggatctagctttttgttagctttcatttttttgagatggggtctcactctgtcccccagactggagtgccactgtgcaatctcagcccactgcagccttgacctcccgcctcagcctcagagtaggtgggatcacgggcgcaagccaccatgccaggctaatttttgtattttttgtagagacagggttttacaatgttgcccaggctggtattgaactcctgagttcaagcaattcaccagcctcagcctcccaaagtgctgggattacaggcttgagccaccgcacccagccttctagtttttaaaaagggaaacaaacaaacttataactagcacgggaaaatttggagaaagaaagctctgaggctgggcgcggtggctcacgcctgtaatcccagcactttgggaggcaaaggcgggtggatcccctgaggttaggagttcgagaccagcctggccaacatggtgaaaccccggctctactaaaaatgcaaaaattagctgggcatggtggcacatgtgcctgtaatcccagctactcgggaggctgaagcaggagaatcccttgatcccaggaggaggaggttgcagtgagccgagatagtgccactgccctccagcctgggtgaaagcaaaagtccgtctcgaaaaaaaggaaagaaagaaagctctcctgtgataagagagtgtgattgatggcgtttttgcttgctcatgtaacatccccccaaactccagatcagcagggaccatgaggatgtcagcctgcacttctggggctggttgctagcgtagggggagtacacagaatttactctcaaagaattgtggttgtaggctgggtgtggtgtctcacacctgtaatcccagcattttgggaggccaaggcaggtgaatcacgaggtcaggagtttgagaccagcctggccaacatggtgaaaccccatctctactaaaaatacaaaaaattagctgggcatggtggtgggcacctgtaatcacagctactcaggaggctgaagcaggagaatcacttgaacctgggaggcagaggttgcagtgagccaagatcgtgccactgaactccagcctgggtgacagggcaactccgtcttaaaaaaaaaaataaataaatttggggttataggtctgacgacttccccaaggactagcagaaaggtttctgagctttttaaccagggcattttcagggctggcatggcttcccaggtggctttagacaaaagcattgaaagacataggtattggcctcaataccctggggcaggggacaacacttgggacaagcaatagacagaccgagcagcctgggaaggaaaagtttggaaaaagagatgtgtgtctgtagaggcttttaaaagtgtctacataaaccaggaaatcaagaaagctgtgtgcaggcccatagtcagttgcaagctcagaaaaggcctaagaaactttgtgaggccaaggcggttggatcacctgaggtcaggagtttgagaccagcctggccaacatggtgaaatcttgcctttactaaaaatacaaaaattagccaggcatagtggcacacacctgtaatcccagctacccgggaggctgaggcagaaaatcactttacctgggaggtggaggttacagtgagctgagattgtgccactgcactccagcctgggtgacagagtgagattctgtctcaaaacaaaacaaaacaaaaacaagcaaaagaaaaggcctaagaagaccctgggctttcatctctttctggccttcagtctctgtgcaagcaggaagtgaaggctaaggcagagtataaatggcttggttaagggttgagagagtgccccaaacagatccaatttgcaaagactaggatagtgtttttcttttcttccttcctccctccctccctcccttctttcctttcttccttccttccctccttccttcctttctctcctttctgcctgcctgctttctttctctctctctttctctgtctttctctttatttctcctgttttcttgtttctttccttttattcttctttatttgttggcttcagccattttaggtagctctcaaaataccagctgactgacaagcaaaaagaacagaaacaaacaaaaagaacagaacagaaaaaaaaaaaaaaaaaccagaaacagaaacacaaagaatacagactttacaataatagtttggaaaatttaccaaacaagcaaaccacagcaacccacgatatacagcaacaatagaccctggggagggaggagaatctgattttcagtgttgccataaattgaaaatgtcaacaaaaaccctcatggcatggaaagaaataataaagttccactcatttgtggcaagaaagaaatgactagatactgtctttgtggcaacccaggtattggtcttactggcaatgactttttttttgagacagagtcccactctgtcgcccaggctggagtgcaatggcacgatcttggctcactacaacctctgcctcttggattgaagcgattctcctgccttaccctcctgagtagctgggattacaggtgtgcgccaccacgcccagctaatttttgcattttcagtagagacggggtttcatcatgttggtgaggctggtctcaaactcctgacctcgtgatccacccacctcagcctcccaaagtgctggattagaggcgtgagccactgtgcccagcccagcaatgacttttaaaaaaaattatttatttaatttttttttagagacagggtctccctctgtcactcaagctggagtgcagtgatgtaatcagagctcactgcaatctctatctcctgggctcagtgagtctcctgcttcagcctcctgagtaggctggaactacaagtgtgcaccacaatgccaggctagacaattactttttttttttttttttttgagatggagtcacactctgtcacccaggctggagtgcagtggcataatctcggctcactgcaacctctgtctcccaggttcaggtgattctcgtgcctcagtctcccaagtaactgggattacagatgcccgccaccacgcccagctaatttttgtatttttagtggagacaggttttcaccatgttggccaggctggtcttgaacttctgacctcaagtgatctgcctgcctcagcctcccaaagtgctgggattacaggcatgagccaccatgcccagccgacaatgagtgtaaattgactgtcttaaatatactcaaagagatgaaggaaaccatggacaaagtcctaaagagagagcactttgcagaagttgtggcgccttgagagccagcagggcagtgggccagtgagatgttgagttattactattattaattcaaatcacatgaatagcaaaccctcagagaacaagaagtctttgttgtatcacaagggctccatcagcagaggtggagtcctgaactcggcacagtgtctggcatatactaggtcttcaagaaagttttagagtaaacaaatgcatccacaatgcttttatgttgggtaaggtctttctagcagtcaaaattttctttctttctttctttttttttttttttcctccttgtgatggggtttgcgggaatgggaacaatggcatagaggaagaggaaaccaaaattatcttgagttagcagatgtctttctcctgtctcctttcttcactaagaagaacagtctttgctgggcatggtggctcccacctgtaatcccagcactttgggaggccaaggcgagtggatcacctgaggtcaggagttcgagaccagcctggccaacatggtgaaaccctgtctctactaaaaatacaaaaattaggtggggtgctgtgtggctcactcctgtaatcccagccttttgggaggctgaggctggtggatcacctgaggtcagaagttcaagactagcctggtcaacatggggaaaccccgtctgtactaaaaatacaaaaaaaaaaaaaaaatagctgggcatggtggtgcatgcctgtattcccagctacttgggaggctgaggcaggagaatcgcttgaacctgggaggcagaggttgcagtgagctgagatcatgctattgtactctggcctgggggacagagtgagactctgtctcaagaaaaaaaaaaataaaaaaataaaaataaaaaacctaaagaaacaaaaaaaaaaacaaaaattagccaggtgtggtggtgcacacctataatcccagctactcgagaggctgaggcaggagaatcgcttcagcccagggatgcagaggctgcagcgagccgagatggcaccactgcactccagcctgggcgacagaacgagactttgtcttttttttgtttgtttaaaaaaaaaaaaaagaaagaagaacggtattgtctttgggtaagcacaggcacagagttaaaaaaaaaaaaaaaagagtcgtgtctttgggactgagtggatgggcatgtgttctgagttagtgtgcccaggtgtggtgaaagacacggagaaaccactgcttgatgcgttctcttttgttgttcaagttgtgggctgctgtggggtggggttacatgtctgcatccccttcgaaaagcacacaatatggcaagtggaagctggagagagctcctaggagtgcctcgtgccaggtgaagaggttgcattgcgggtggtgggtaggtgcctagggagaggaggtccacgcctgttgtccttccagcacgatggctccaaaagcagagcgaagaggtgatgttcccacttcccaaggcatccaagggacggggcttgaagaatgcagcctagcaaccatgtgcgtaagactgtggggaaggagggcttgaggatgagcctgagagtcaactggactgtggggaaatagtgtagccttctttcctttgagcttcagttatctcgcctgtggtgatgatgacgatgatgataaagatgataccatacttctatggcacatactatgttccagatattgttcatataactcatctaattttcatagcagttttacaagatgagtactatttgtttttgtttttttgttttttttttttgagatggagtctcgctctgttgccaggctagagtgcagtggcgcaatctgggttcactgcaacctctgcctcctgggttcaagcaattctcctgcctcagcctcctgagtagctgggactacaggcacataccagctaatttttgtattttcagtagcgacagggtttcaccatgttagccaagatggtcttgatctcttgacctcgtgatccacccgcctcagcctcccaaagtgctgggattataggcgtcagccacagctcccagccaagatgggtactatttttatacctattttatagaagaggaaactgaggcatagagaagtcaagtcacttgatcatacagctagtgtgtggaggaggcagattcaaaccctggcttcggtcttagtcactgcattggcttcatgggcttatcatgaggattaaacgcgtgaacatgctcagtgtttagttcagtgtctggcacaggatcaatgttcagaaaatcctaacagctgctgtcagtatcagaacccaaacaaacaggtgggactttcgccaactctctaacatcacatgtgcttgtataatcagccactgtttttttcatgaaaaaaaatttttttgagacaggttctcgctttgtcacccaggcaggaaggcagtggtgagaacacagctcactgtagcctccacctcctgggctcaagcgatcctcccacctcagcctcttgtgtagctggaaccacagcatgtgccaccacgcccagctattttttaatatatttttttattttttgtagagatgaggtctcaccatcttgcccaagctgttctcaaactcctggactcaagcagtcctcctgcctcagcctcccaaaaggctgagaatacaggcatgagccactgcgcctggctaatcagtcacttgttgttgttgttttttgtttttttgagatggagtcttgctctgtcacccaagttggaatgcaatggcgcgatctcggctcactgcaagctctgcctcctgggttcaaatgattctcctgcctcagcctcccaagtagctgggactacaggtgcacgccaccacacccagctaatttttgtatttttagtagagacggggtttcaccatgttggccaagatggtctcgatctcttgacctcatgatccgcctgcctcagcctcccaaagtgctgggattacaggtgtgagccttaatcccaaagtgctgggattacgtgcctggccttaatcaatcacttttaaaggagagtggggaacatcatgttttgcaactattttttgaactcttggatatttacttggaacaaataaaaacacttttgtaccatgtgaaaggtaaaatttgctcaagccgtccctcatcctgccctggcctgcttccacatgcggctgggtgagctgaccccattctctgtttatttattgtttttgttattgtattttattttacttttttgagacagagtttcactcttgtcacccaggctggagtccaatggcatgatcgtggctccctgcaacctccgcctcccagattcaagcgattctcttgtgtcattctcctgagtagctgggattacaggtgcctgccaccacgcccagctaatttttgtatttttagtagagatggggtttccccatgttggccaggctggttttgaactcctgacctcaggtgatctgcccgcctcggcctcccaatgtgctgggattagaggtgtgagccaccgcgcccggcccattctcagcttcttgatggcttccccctactgggacattgatcacttattcatgacattgactggtcatgagccactcctccgccagcccttggaggatccaagtgattcacaaatggacacaaggaatatgattagtcctctgtgagtgattctgaggggccgtggtatagagagagagaggggaaggaggatgggaaaatgccggcagttccctccccaacccattctgacagtttgctggttagagaaaaatccccatgtcagagaatttttttctttgtttatttcctgtgaaatagaatgtgggtctggcattggggaggactctagtaattcatattttctgcttatttggctcctggctgaacaggaatttacattacttaatgtctgggtttttcctggggaatcaaaataagttttctattcaattattaagcaaatttcacagccaaataatcctcttatttttacaagtggtattttccctggcagagggttttctggcttctctgggtacttgatccgtctcctctcttctgtttcctctgtctttgtctggctatgaaggaagctaaagcccctcattcatggattaggggcttctcaatggcagttggcagactttggctttgcaagctagagatgaatcttttttttctttcttttttttttttttcgagacggagtcttgctctgttgcgcaggctggtgtgcagtggtgcgatctccactcactacaacctctgccttccaggttcaagctattctcctatctcagccttccaagaagctgggactacaggcatgcaccaccacacctaatttaaaaaatactttagtaaatggctaatttaaaaaatatttttagtaaatgggaggttttaccatgtcggccaggctggtctcgaactcgtgacctcaggtgatctgcctgccttgtcctcccaaagtgctgggattacaggtgtgagccactgcgcctggcctagagataaatcttaatgtccgccagccatggggtaagagtccactccctctttctgctcttcagtctattgactttgggcacaggcacagctgcagctctagtaggggttgggcctggagtcagtggagacaaaatgtgaaggtaacaggacagtgcacggggcccagtgtgctctgcctgggctgctcagggaagaaaaatcacacacacacacacaaataacaaccctttttttggcagaagtatagtgaaagatctctacgtcttggccagcatttgttatctttttgcttctttgaaaatagccatcctgggccagatgcagtggctcacgcctgtaatcccagcactttgggaggctgaggcgggtggatcacctgaggttaggagtatgagagcagcctggtgaacatgatgaaacctcttctctactaaaaatacaaaaattagctgggcgtggtggcacgcgcccataatcccagctactcgggaggctgaggaacaagaatagcttgaaccctggaggtagaggttgcagtgagctgagattgtgccattgcactccagtctgggtgacagagtgagactctgtctcaaaaaataaataaataaataaattaaaaataaataaataaataaaggaaacggagtcagtgtgttgaagagatatctgcactcccatgttcactgcaatattattcacaatagacaaggtatagaatcaacctaagtgtccatcagtggatgagtagataaagaaaatgtgatacacatacaccaatgtggtatatatactcttcagccttaacccatctccataaaattaaggaaacaaagaaggaagtcctgttattggtgacaacgtggatgaacctggaagacattatgttaagtgaaataaatcaggcacagaaagacaaataccacatgatctcacttatatgtggaatctaaaaaagttgaactcactgaagtagagagtagaatggtggttaccagaagcaaggtgagggtgtctgtgagagggttggggagacattggtcaaaagataaaaaatttcaattagccaggaggaaaaagttcaagaggtctattgtgactagttaataaaagtgttctaaccacaaaaatgatccatatacaaggtaacatatatgttaattagctttatttagccattccacactgcgtatatcaaaaaatcatgtacaccataaatataattattattattttttgagacagagtttcactcttgttgcccaggctggagtgcaatggcacgatctcagcccactgcaacctccgcctcctgggttcaagcgattctcctgcttcagcctccctagtagctgggattacaggcatgcaccaccatgcccagctaattttgtatttttagtagagatggggtttatccatgctggtcaggctggtctcgaactcctgacctcaggtgatccgcccacctcggcctcccaaagtgctgggattataggcgtgagccactgtgcccggctcataatttttatttataacaaaaagtaaagtgaacctcctgtagacagagtacagttggatcttgttttttcaacctattcacctactctatgtcttctaattggggaatttaattcatttatacttaaagtaattattgatagataatttacttagtagaagtataactttgagcctgttatttaccttttctaaatgagttttcatttctgtgaaatgggcacaattaaagaggccgcctcctgggactggggtcaggattagttgagatagtctgtgtaaggctaggatggtgcttgacagccagtgttaattattattttttgatcctgtgggatagggcaacccagatactccggtgggaaacacttgcaaccagagaaccttgactcaaaatcttggtcctacttggtttgaaggatcccattgcatttgcattgctgccccttctgagaggttattcacactgataaaccccattttgcaacttacacgtgcaggattcagctaattggacagcagtggacactgaacctaaggtgaaaaatccaacaaatagagaggaccaactgaaaaattcagttgctttcttttgaagaatctgaatacgagacacagagaaaggattagtagtcagtattgagggcagaaacagaaacacagagaaggaaagttataagaggaagctttgagtcagcagaagctatgggtgaataggagccatgaattgacaggaattatgagtcagcagaaacttgagtcgtggcaagagccacaagtcagcagaaactatgagatagagagtagcatggagatagcagaggaataggccaagacccggagatgctgcgtcaccatcttggtggagcctagagggcagagctaggatggtcccctgaattacagagctgctgtcagtgatgagtgtaacctgaagatgttccagcctctggcagccctgactgggtggtgagactttggccttccagctttcataaagtaaactgagaatatttctgtttctggccaacttacaagaatctgactgacacactacccatatcaaactcctctgagactcagttttcttgcctgtgaaatggggacagctaaatatacaagttgaatgggttgagaaaacaagatccaattatattctgtctacaagagactcattttactttttaattacaaataaaaattatatgtatatatgatattttgatatatgtatacagcatggaatggctaaatcaagctaattaacatatatgttaccttgtatacttgctttgggctgcttagcatcccttttttggggataccagcctttatttgacatctgccagtaacaggattctacctctaaggtggccacataatccaggccgggcccgtcagagcctcattgtagaaatttgccttcaggtcaggaggtggaaaccctgagagagttcctgggttctgggatattctaagctgtccaggctcctgtgttttctttgtttttagagacggagtctagctctgtcacccaggctggagtgcaggggcacaatctcggttcactgcaacctccgcatcctgggttcaagtgattctcctgcctcagcctcctgagtagctgggattacaggcatgcgccactatgcccagctcatttttgtatttttaatagagatggggttttgccatttttggctaggctggtctcaaactcctgacctcaggtgatctgaccgccttggcctccgaaagtgctaggattacaagcgtgagccaccatgcctggccggctcctgtgttttctaaggccagtttattcaactctgttttctttctgagagtttccgaatggagtcatcccttggtatccatgggggattagttccaggactttccatggataccaaaccccacagaagctcaagtccctgatataaaatgatgtagtctttgcatttaactatgcacatcctgctgtatactttatttttatttattattattatttttgagatggagtctccctctgtcacccagactggagtgcagtagcgcaatcttggctcactgcaacctccgcctcagctaggttcaagcgattctcatgcctcagcctcttgagtagctggaactacaggtgtgtgccaccacgcccggctactttttgtatttttagtagagatggggtttcaccatgttggtcaggctggtcttgaactcctgacctcaagtgttctgcccatcgcgacctcccaaagtgctgggattacaggcatgagccaccatgcctggccctcctgtatacattagattatctctagattactcataaaaatgaatacaatgtaaatgccgtgtaagtagttgctatactgcattgtttagggaatcatgacaagaaaaggagtctgtatgtgtttagtacagatggtttttgttgtcgattaaaaatatatatatattttatagagacggggccttgctatgttgctcaggctggtcttgatcttctggcctcaagtgatcctcctgcctcagcctgccaaagtgctgggattacaggcatgagccactgtgcccagccttcctgaatatttttttaattctcggttggttgaatccatagatgcggaactcacagaggcagagggccaactgtagccttcctacagatatttttatcttgttaaagtaataaccctaacctgacccacacctcacaggtctgttgtgaagtgacataagccagcacataagtggaaaagcttggtgaatgatttaaaggaatcttctggcctggtgcgggggctcacgcctgtaatcccagcactttgggaggccggagtgggtggatcacctgaggtcaggagtttcagaccagcctggtcaacgtggtgaaaccccgtctctactaaaaaaaatacaaaaatcagcccggcatggtgacgggtgcctgtaatcccagctactcgggaggctgaggcaggagaatcgcttgaacccaggaggcggaggttgcagtgagccaagatcgtgccactgcactctagcctgggggacaagagtgaaactccgtctcaaaaaataaaaaaaggaatcttctggcctctgtttcagttgaacaaagtgaggtctagagaggggagaagtgagcagttccaggtcgcatgggcggtcaggggtgaaaggggagtggggacgtgaactccaggcgggtgctctttcgcgcctcctggtcgctccctccccttccctccccttccctccccttccctcctcttccctcccccgctctccctgatgtgcctgccttccctacctaacagctctgagttctgcctacctgaattagcccaatgttttcaccctttgaaagaagattctaagccgaaaccagcccccagttccccgtgggctttgcccactccttgccaagcactctgagtgctaccctttctctttctgaatagggtgagatacttgacgctgccctgaatcgaagtcaaacgggggctcctctctgcagtaccacagagctccctgtaggtggcagggtaggactgcaaatgtcctggaatattggtccctgagcgcaagcccagactggagctggggtacagcatttacttgccgtggggaagaggaggacgccggagggaggaggaaggaaagtagaagtgttgccagtcttgaggcaaaagagagttgatttgagggccgaaggacaggaatagttggtgtacctcatccgtctatctctccatccacctacccacctatatacccaactaccctccatccatccacctactctccattcacccacccactcacccatccacccatccacccacccacccatccatctacccatccatccatccatccatccatccacgcattcatccaaacacccatctatccatccacccacccatccgtccatgggttcattcatccatccatctaccaatccactcatccatccaataaatatttttgagcacctgtgctaaatgcatatacacacacacatatctatgcacacacatacatacacactgatatatatcacacacatgcatacacacacacggagaataaccggtactgccttttgttgagtgtcaaggttgcttttatctctccagctggagatttctgcacctgtctgtagcatccattactagcatcccattcccaatattattattcactcctttacttccgaatataaagcagatgtcatctggggccctttttgccccttctgatttcaataaaattttccccaacgtcctgtcttcctcctcctcctctatcccattcctgaggcatctcaagtcttcccttggatttctgtcaactcctgacttttctgcctctagagctttggctcctagtaggatatttctgacctgcagcatatcatattctttgtttttaaaatttattattgttggccaggtgcagtggctcatgcctgtaatcccatcactttgggagaccgaggcaggtggatcacctgaggtcaggagtttgagattaacctggccaacatggtgaaatcccgtttctactaaaaatacaaaaattagctggatgtggtggcatgctcctgtaatcccagctactcgggaggctgaggcaggagaattgcttgaacccggagggagaggtttcagtgagtcgagatctcgccactactccagcgtggacgacagagcaagactccatctcaaaaaaaacaaaaacaaaaccaaacaagcaaacaaaaaaaaaaaaacaagaaaaggcagctcagagaggtcaagtgtctagcttgaggccatacagctaactgggtcagaactgagatttgaacccatgtatgtctgacctggtgctgggctcttttctgtagaggattcatccagccccacatacctggtctagaagaagggaagtggtgggagaggagcaccccagagagaggagcccgaatcatggggctgcaagctggtcctgggtcccatggagccatggggtgaggaagtggcaggggctaccaccaaactcagatgcgggcccaaggctggttgggggagaggaccctggctgtgggtgcccatctgccagcttgtatgaaggagtaggcggggtaggtgggagaagggaagtggtgcttcggtgggaccacaggaaacgctagattttggttagtagttggaaagtaccagcaatttctctttcaacagaaaaccagaaggaggtcaggtttttcttattaaaacagagacaaatgcagactttgcaaaggaagcagggatttgcagagtgaggctggaagtcaccgaagctgagtgatattccccagagaaaggttttacattcatgtggagtgggtcagaggaccttgagttgagctgatgagcagccacaggatggcaccaggttttcacgatatggagagaaggggacctggtggtggtttggccaccgtgtcctgtttcctgaagaacagagggtgtacgtgacagctggggcctcatagccagttactgccagcaggactccatctcaattcagatcttacttcatgggactacacagaaagaaggaaagccaggccgggcatggtggctcatgcctgtaatcccagcactttgggaggctggggtgggcagatcaatagaggccaggagttcgagaccaacctgaccagccttcaccaatggtgaagcccatctctactaaaagtacaaaaattagctgggcgtggtgacgggcgcttgtaatcccagctacttgggaggctgaggcaggagaatggcttgaacccgggaggcagaggttgcagtgaggcgagattgcaccactgcactccagcctgggtgacagagcgagactcggtctcaaaaaaagaaaaaaaaaaaaaaaagctgggcttcgtgaagggctcacacctgtaatcccagcactttgggaggatcactttgggtggattgcttgagcccaggagtttgagaccagcctgagcaacatagcgagactccatccttacaaaagataagaaaacaaaagacagaaggagtggtttggagctatgcaagtgtccctcttggctctggcaatttctgggtggataaccttgggtagcacccttctctttgaatctaagtttccttatctaaactggcgatgataagacctcccttgctatgttgttataaaattacttgtgtgcctagcccagagtaggtgtgcaatgaatgagtaaatggatgaatggctaaattccacacatatttatggagtgctaagtctgtgtcaggcattaccttggggacacagctggaagtgaacaagccccagtcttcggtttttaggagcccacattctggcagaagagacaggaagtagctgggcagggtggctcatgcctataatcccagcacttcgggaggctgaggtgggctgatcacctgaggtcaagagtttgagaacagcctggccaacatggtgaaaccccatctctactaaaaatacaaaaattagccaggcatggtggcatgcacctgtaatcctagctactcggggggctgaggcagggaaatcgcttgaacccgagaggtggaggttgcagtgagccgagatcgagccaccacactccagcttgggtgacagactgaaactccatctcaaaaaaaaaaaaaaagagagccaggaagtaagtgagacagataagatcaacacagagcatgctaaacagaaaagtaggaaagacatactattcagtgttggggtgggtggggagattaatatttcagaaagggtagcctgggaagggctcattgagaagctgactgttgaataaagattggcaggaattacgcaaccagccgtgtagatctctgggagaggagaattccggggagaagggacagtcagtgcaaaggcccttaggccagagcatgcttggggttcaagaaacagagtgagtgccagtgtgcctgaagcccagtacagaagggagaaggttgtcggagatgaaggcaaagaggtaatgacgggtgggttagagtttgcagggcctttggaagctgtgagaaggattttggctttttttctgggtcagaggggagccagtgcaggagtttgagcagaggagtggcatattacggttctccagagaaagggaaccaacaggatatacacatgtctacattaatcaattaattattttgagggggttctccagagaaagggaaccaacaggatatacacatgtctacattaatcaattaattaattttgagattgagtttcgctctttcacccaggctggagtgcagtggcacgatctcggcctactgcaacctccatctcctgggttcaagtgattctcatgcttcagcatcccaagtagctgggattacaggtgcccgccaccacacctggctagtttttgtacttgagacagggtttcaccatgttggccagcctggtctcgaactcctgacctcaggtgttccacccgcctcattcttcccaagtgctgggattacaggcatgagccaccatgcccggcctatattaatttctttacagagatttattataatgaattggctcgcatgattatggaggccgagaagtcccaagatcggcagctggcaaacaggagacccaggagaactgatgatttagctccagtgtgaggcccaaagaccctgtgagttcccaggagagccaatgacataagttctggtcctaacgcgagcagacttgagatgcaggaaaagccaatgtttcagttcaagtctcagggtggaaaagcacagtgtcccagcccaagcaggcaggcagcaggagttctcttgtactgtgcctttttgttctatatgggccttcaacggattggatggggcccacccacattagggagggcgacttgctctattcagtctgcagttcaaatgtgaatctcacccaggaacacccttacagacacacactcacaataatgtttgaacaaaaatatctgggggccaggcatggtggctcacacctgtagtcccagcactctggaaagccaaaatgcgtggatcacttgaggccaggagtttgagaccagcctgagcaacatgacaaaaccctgtatctataaaaaaaaatacaaaaattagctggtatgatggcaccacatgtggtaccagctactcaggaggctaaggtggaaggatcgtctgagttcagggaggttgaggctgcagtgagccatgactgactgtgccaccgcactccagcctgagcgacagagcaagaccttgtctcaaaaaaaaaaaaaaaaaaaaaaaatctgggcagcccgtggcccagtcaaactgacacatcaaattgaccatcccaagtggcttcactggatgtagctttctacaggctctctctggctgtggtgttgagaatagtatgaaggtaggggtagggttggggagtcagaagcaggaaggtgaatttggtggctaccatatagtcatccaggtaagtgtggtggtggcttggactaaagtggtagtaagaggtgtgacgaggttattagattctggatgtattttgaaaggagtgcagatggggtgagagagagaagaagagaaataatgggtgacctgtggtttttggcttcagcaccttaaagaatgaggttgccactgattgagaagggagtatcaggagtatggcggacacgttgagtgtgagaaatgtaagctttggaggagatgtggggtcagcaggtagatgtccatgcctggagtccagcagagcagcctgggccagacagctggatttgggagctgtcattagcacctgcctggctgtcttcattattgcatcaagagtggctcttggttgcaagtaacagaaaacctggctgcaggccagacatggtggctcacgcctgtaatcccagcactttgggaggccgaggtgggtggatcacctgaggtcaggagtttgagaccagcccggccaacacggtgaaaccctgtctctactaaaactacaaaaattaaccgggtgtggtggcatgtgcctgtaatctcagctactcaggaggctgaggcaggagaatcgcttgaacctgggaggcagagtttgggtaagctgagattgcaccattgtactccagcctgggtgacacagcaaaactccatctcagaaaaagaaaacttagttgccttgagcaaaaacagaaattattggaaaactctaggggtccacaaacccaccaggaagctggggatccaggctggggaaatgagtgggggccaaggaggctgtgaagatctgagcagcggcagccacagaaaaggccccggcaggagcaatccggtcctaaaacccccatggctaccatgtggataggccctcctgcggccccttgctgggatcaccgctcatgatgcagagtctgaggagagcagctcattggttcaaccaagccacatgaccttcaggctggggtgcagggagggaggcctggccacttagggtttccattttcttttttctgagacagagtctcgctctgtcacgcaggctggagtgcagtggtgtgatctcagctcactgcaacctccgcctcccggattcaagtgattctcctgcctcagcctccccagtagctatgattacaggtgcgtgctaccatgcttgcctaattgttgtatttttagtagagacggggtttcaccatgatgaccaggctggtcttgaactcctgaccttaagtgatccacccgtctcggcctctcaaagtgttgagattacaggcgtgagccactgcacccagcccactgagggtttcctagtggaggaggaggccaccatcccctcattgtggtgtttataatggggaactcccagaggagccaccagggtaaaagaggaagagatgagatgttggactggcataaaaaaagaaaagcagaccaaaactccagcgtgacagcagcaaagcccatcacaactgcatcataattatcatcagcagcaatagcagctggagtgatttcttttctttttttgagacagggtcttgctctatcacacaggctggagtacagtggtgtgatcgtagctcactgcagcctcgacctcccaggctcaagcagtcctcctgcctcagcctcttgagcagctgggactacaggcacaagccactataccaggctaagttaaaaaaaaaaaaaaaagtgtagagatggagtctcacttaggctggtcttgaactcctggcctcaagcaatcctcctacctcggcctcccaaaatgctgggattacaggcaggagccaccttgccaggctgatcttttaaattctttcagcgtcaaagccaaagttttctcaatgtcctaaaaggccccaggccctctgccctccctcccctgctaccccgccctgtggcctctctgacctcatctcctgttgttcctgccttgctcattcttccccagcctcactggtcccctggctgcggctccaaaacgctggccactcctgccccaggacacttgcctttgctctcttccgtgcccttcccagacatccccacgacttgctcccttactgccttcaggcttctctctctctctctctctcttttttttttttttttggagatggagtctcactctgttgcccaggctggagttcagtggtgtgatcttgcctcactgcaacctccatctcttgggttcaagtgatccttctgcctcagcctcctgagtagcgggggttacaggcgcatgccaccatgcccggctaatatttgtatttttagtagagatggggttttgccatgttggccaggctagtttcaaattcctggcctcaagtgatctgcctgcctcagcctcccaaagtgctgtgattacaggcatgcgccacggtgccccgctgagacttttctccaatgtgaccttctcagccagacatccttgatgatgccatttacatttgcaatgctccctctatcccatctcctcccaggaatgcctcttcatgtctttgctttttttttttttcccccacagaacttctcatcatcttcatgctacatatctctgtttcttgtgtatctccctcctccatgtggatgggggtttccagaaccgagcctggtatggagcaggcggtcaggatttgctcttgaatgaaggatgggggttcactccctggagctatgttgggagccctgttctgaggagctctggcttcgtgggtccccaggacccagggtaagacagtccactccttgggcaatgactgggaccagtacctggggaggttggggcccttcatcccaactcagtcccatccttgagggaatcaactgtgactcacagctaacagggtgagcagagctgcttcttcagtcacgaatgaaaataaccttgtctctgtaaacaaacagctctcaatttattcattgggaagaaagaagtgtgtgtggaaagaaggaggcactttcctggggggcggagtgtcagagtgttagacttgagttactcagagtaattgattcacgatgctgcgtgtcaggggtgttacatctaatcgggagctgtccatacaatttctcactaattgtcactgggcgccataacaggataatgactgttggggcacaagagacttggatgtggtgagccaagggtatcattttgatttttgttttgagatgtgctggaactcagatgaccctccttaccgaaaggctccatccctttaaatttttttttttttttttttaagagatgatgtttttctgcgctatgttgcccaggctggtctcaaactcctgggcttaagtgatccttccacttcagtctcccaagtagtggggaatgcaggtgtgagccactgcacccgactgaaaagctcattctttttttgttgagacagggtctcacgctgtcacccagacttggagtgcagtggcgtgctcacggctcactctagccttgacctctcaggctcaagctatccttccatctcattctcccaggtaggtgggactacaggcatgtgccaccatgcctggctaatttttttattttttgtagagacgggggtctcactatgttgcccaggctagtctcacactcctgagctcaagcgatcctcccaccttggcctcccaacatgctgggattacaggcatgtggaaggttcattgtttagccagagttttgttctggaccggagacaatctagagggatgcagacctgggcttggaccaccagaggtctggctggacccctgggggccagaagtgcctagttgaggggtatcttcttggactcgttacttactcctcactttgaacctgtcaccaagtgtgtcagttttgcctctaaagcatctgtcagctctgtccacttctctccactcccactgccaccccctgctttcacctggtgaccacagacgctgcttagcttctgctctgtctcttattcccttccctttgcctctacccgggagcatacatgtaatggtgacagttccctgcataacacactgcagcggtcccattcccttgaggatgaagaccaaaatccttaacatggctcaagagatcccacaaccatctggcccctgcccacttctcagcctcactgttcaccattttctccaggcaaaaggaaggaccagtgacctaagaatgccatggggctgctgccctcattttgcactctaggattttgaccttattatttcctgtgcatgggatgctttcttcccctccctccctccctttcttccttccttccttccatccatcctctttctttctctctcctctccctctctctctctccctccctccctcccctcccctgcctcccttcctcctcctcctccttctttcccctctctctctctttctttttgagacagggtctcattctgtcacccaggctggagtgcagtagtgtgatcgtggctcactgcagcctcaacctcctgggctcaagtgatcctcccaccctagcctcctgaggagctggataccactgtgtgcagtgagtgcatgccactgtgcccagctaattttttgtattttttgcagagatggaggttttgccacgttgcacagtctggtctcaaactcctgggctcaagtgatctgcccacctcggcctcccaaagtgctgggattacaggcatgagccaccgcacctggcctaggagctgcttcttagatcttccgcagctctttctcatcaccagctaaaatgctgtattctggtagcattgtctttatcctcctctggactgtatctctcttgaagtcttccattccagttcatttctcctgagcctagtacaataatacatagaaagcgctgggatatttttaaaaatactaatgtttagaatcaattttaattccttctgtaaaaaatatacgtattttgcctttttaaaaaaatgcaaaactgggccaggtttagtggggcatgcctctagtcccagctacttgggaggctgaggtgggaggatggctggagcccaggagttcgaggctgcagtgagccatgattgcaccactgcactccaacctgggcaatagagtgagatcctatctcaaaaaaaaaaaaaaaaaaaaaaaaggaaaactcaagtccttttagtgatcacaccaagttcctgcaccttgtcgcttttttattttattttattttatttttttgagacagagtcttgctctgtctcccaggctgaagtgcagtggcatgataccaacttactgcaacctccgcctcctgggttcaagcgattctcctgcctcagcctcctgagtagctgggattacaggcatgtgccaccatgactggctaaattttttgtatttttagtagagacagggtttcaccatgatggtcaggctggttttgaactcctggcctcaagtgatccttctgccttggcctcccaaagtgctgggattacaggcgtgagccatcacgctcggccagcccttgtttttatgaacatcgtgtatccttaaggaccttcaaatacttctgcatccatttgtatgcatctttagttttgttctgaaaacctcaagatatagcacgctatgtgtatagtttgcaacttgaatttttttcactcaacactgtgtttctgagaccaatcctcgctgatacatagagagctagttaattcctcctgccttctgcatagcatctcactatgttattaattgccttttgttttctcaagctatttctgtgttgatgggcatttgtgttgtgtctactgccttgctattgaaaatagcacttcagtgcgtgcaccgcgtaggcctctgtgtactaccgtgaagtgtttcctgaggccagtagttctcaacttggctgcagacagaatcacctgaacgttttttttttaacaatcacaccaactctctgcctttccccaaattcttaattgaatggttcagggtaggcatcggcagttttagaagctccagggtgcttctaaatgtgcattcagggttgagacctgctgttctggggtgtacattggggatgttggtgttgcaatgactgggccaaaagaagaacccaaccccgtgttttaccaggctctgcccaattgcctttcaaggtgactgaactgatctacatcctgctggcagtgtgtgagcgaataatgactgttttgtgtgaacaagtgactaccagtcactgcaggtcagtgaaccagagcgttctccactgcacaaactgcctccaagtggctcatcaccatgggctacagcccacaaacgtctgagcttggaatgctttgtgtccttaggtggcagcttggtgcagctgaaaaggtgccaggctgctaatgggacaattcggagtccagttcagacccaggttctaccttgctatgtgtcctcccaggtcacatccccacactgagcctcagcatccctgcccttggagggaggagagctggaaactcacctgcggtcattttcatgtttctcttctgtctgagccacacgttacttgcagcctgtggtctgagcatgggcgttagagcccagtcctgaatagtttctgcactgtgggccctgttggtatctggggaagcctattacccttctcagagcaatgtttctttttcttctcttttctttcttttcttttctttcattttttgtttgagacagagtctcgctctgtcactgaggctggagtgcagtggcatgatcttggctcactgcaacctctacatcctgggttcgagtgattatcctgccttagtctcctgagtagctgggattacaggtgcctgccaccacgcccggctaatttttgtatttttagtagtgatggggtttcaccatgctggccaggctggtctcagacagctgacctcaggtgatccacccgccttggcctcccaaagtgctgggattacaggcgtgagccacctcgcccggccttttttttttttttttttttttagagacggagtgtccctgtgtccctctgtcacctaggctggagtgcagtggcttcatctcagctcactgacctccgcctcccaggttcaagtgcttctcctgcctcagtctcccaagtagctgggactataggcatgcaccaccacgcccagctaatttttgtgtttttcagtagagatagggtttcaccatgttggccaggctggtcttgaactcctggcctcaagtgatctgcctgccttggcctcccagagcactgggattacaggtgtgagccactgctcccagcctctgagcaatgtttctaaatatgaaatccaaaggcttgtgaagacaactgattatatggaaatacagctgatataaatattacaaaattattacaaaaatattacaaagccaaactgtgatatagcaatacccatgcctctttattaacacaccaaataaggcgatctgatggtgggttggcaacattattacgattgcagtttaaagcagtgatgagtgtaaatgatattccaacatctttgcaacaaatgtaacaggacatgaaaatatctgtgattcctgttggtgacaaagttacaggttctgttgacacgacggcagtttgctgcctacactcataatggaaagaattgctacattgcagtttgatgttagtaaaattaagaggtctattttttcttccgagttcattgagttcattgattgcaggttactggcccttgctagagttatatagacttgagtttctttcttttttgtgagttttttttttttttttgacggagtcttgctcgtcgttcaggctggagtgcagtggcacgatctcggttcaccgtaacctccacctcccgagttcaggcgattctcctgcttcagcctcctgagtagctgggattacagcatgtgctaccacgctcagctaatttgtgcatttttagtagagacagggtttcaccatgttggtcaggctggtctcgaactcctgacctcaggtgatatgccccctcccctccttggcctcccaaactgctaggattacaggtgtgagccattgtgccctgcttttttgtggctttttaaaaatttttattttgtagagacgaagtctcactgtgttgtccaggctggtcttgagctcctgagctcaggtgatctttctgcctcagactcccaaaatgctgggattacaggcataaaccaccatcccaggctagacatgggtttcaatctctgctctatagcttcctgtgtgggtgcatttgggtaaattccttttctttcctgagtctcagtttcctcaactgtaaaatgcatgtaagacagtgagctcctagggtgctgggaagagtaaatgtgacaaatcaaattcaacacacatttgtagagaacttttgatgtgctcagggccattttcggtgccaggatgctggaccgaatgagaagggcaaaatccttgcccctctggagtttacagttcgggggcagagacaatgaataatgaggcagataagtaaataacggtttcagataatactaagggcaatgaagaaaatagtacaggtgatatgaaagggaacaaatgcctggtgcaggtgacattaaatagggcaattaggtaataatacagacagaaatgaacaatattgatgcataagacgagagaatgtatttgaagtatcagctcggcacctggtacgtggtgtatgttccatttgtgctggccacggtgatgatgatgatgatgccatctctccggctacactgcgagcacagatcacagctctctgtagctgatgctggctctacccactgtattcggggctggatgaaggtggggccatggaagcgttctacacaagaactcagcagtcctgttggagccagattggaaggaagcaggtctgattaaaggaagataaagtcttctctctgctaagtctcgcagggagagctaggcaatcaataggtctcgcagatcagtggagggtgcttggaatctggcagcatggggctttttaattaaacctataactgtgagaaaaggtaactgccttatttctgcagcttgtgtttctgtctgcctgccagaaactgaacaaatcaatgcacttccagaggttctgaggatcttgacaagggggcctctggttttgggatggccagaccctgcagggataaactctcgagtggccagggtgtcaggtaccaattctggagggtcaggtgttgccttttacatttaaatacccatagcaggtgtgattagcaactgcaattcaggggaaggcgaggccccttcccagccagcagcagcttgccttccaggattttataccaagctggccccctaccaccacaagatgtcaacattcctttttttaatagaagattttcttttattgtgggccaggcatggcggcttgctcctataatcccagcactttgggaggccgaggctggcagatcacttgaggtcaggagttccagactatcctggtcaacatggagaaacccctgtctctactaaaaatacaaaattagcttggcatggtggtgtatgcctgtaatcccagctactcagaaggctgaggcacgatcatcatttgaatccgggaggcagaggttgcagtgagctgagatcacaccattgcactccagcctgggcaacagagtgagtctccatctcaaaaaaaaaaaaaaaaaaaaaaaaagattttcgtttatcatgaagtagaattatgctgtttagggtatggtccatgcaccagcatcacagcatcatctgctgggaatgtgtcagagatacagaactccagccccaccccagacctactcagttagaatctgcattttaaccagatcatcaggaattcatatgcatattgatgtgtgagaggcactgaaattgaacatacatatgagacttagaagacaaagaagccaaatgccaatatgcagaccttatttaaatcctgagagagttaagaagttatctatgagataatttgagatttgaacatttgcagatattaaggaattattcatttcctaggtgatagggaggttttatttcaaaaaaaaaaaaaaagagcccttttggccatgcgcgatggctcatgcctgtaatcccagcactttgggaggctgatgtgggtggatcacctgaagtcaggagttcaagcccagcctggccaacatggtgaaatcccgtctctactaaaaatacaaaattagctaggcgtggtagtaggtgcctgtaatcccagctactcaggaggctgaggcaggagaattgcttgaacctgggaggcagaggttgcagtgagccgaggtcttgccactgcactccagtctgggcaacaagaatgaaactctgtttcagagaaaaaaaaaaacccttttcttttagagttacacatgaaaatacttagagataaaatgatttcatgctcgcatttgttttaaaatactggtggagctagacaaagtcttgacgtttggacacagcacgaatgactgtgagttgatggtatggggaactgtgtcacgacccaggcagacacagtacacagtatactgtttacttagtatatgtttcaaattccccacggtaaaaacctaagatgatgatatagaatattcacatagaaaatgcatgaaacaggctgggcacagtggctcacgcctgtaatcccagcactttgggaggacaaggtgggcagatcacctaaggtcaggagtttgagaccagcctggccaacatggcgaaaccccgtctctactaaaaaatacaaaagttagctgggcatggtggtgggcgcctgtaatccccgctactcaggaggctgaggcagggagaattgcttgaacctggaaggcagaggttatagtgaactgagatcacgccactgcactccagcctgggcgacagagcaagattctgtctcaaattaaaaaaaaaaaaaaaaaaaagaaaaagaaatgcatgaaacaggaaggtgttgtgatgagcattagttcaagtggacatccataaatctgttaccaggtcattaccggctcctgccctctgtcagaacctctgccccagagtaatttcttccctcccattctctggggcgctctcacccctagctgcctatggaatcgcctgggaaaactttacaaaacaatgcagttgagcctcctccagtccaatgaaaacatactccctgggagtgcgcacaggtgattctaatgtgcgaccttagctgccctagcttttcaggtgaatgccatatttgtgcttgaatttctcaacgagcttactgctgcttacatccaacaggcaatttcactttctcatcaagggactgagttgctggactgttgtataagcacaggttacattgcaacccatttttttccttttttttttttttttgtttgagactatgtttcgccgtgttgcctaggctggactcaaacttctgggctcaagtgatcctctctcttcagcctcttgaggagatggggctttagctaccgtgcctggcttgcaacccatttttgaaactaatgggtttttgtgtatttgtgataaatgtgtatctaccacatattgagtgctttccatttctctggaactctgctaagtactttattttatttaatccccaaaacgattgtggggtcagcatccctgtccctattatactgatgaagaaacaggctcagagagactatgtggcttgcttcaggtcacccagtttaaaaagtgctgagtgtggattgggttcatagctctctgacttaatgctcttaagcatcattttgtgccgttcattcagggtcttgattgaagagttgagggccagttagccacccacaatgaactggaagtaaacatggagaggtcgtcacagtgtcactcgaggcacacttaagtggtgtgccttggagctgagtttccgtctttgtcaaatggggacagcactgttttgtcttctctggctgacaacctcttactcatctctcaaaagtgcgtcagttgtcacagaatggggaagccggaaagctcctctgaatttcaagggacctcctggctaaagcagaattagtcatgtcctcctctagcctcacagaccacttgtccaggtctctgagagcagtcgacaggagccctacacttgtcatgtgagacactggcgcgtctaagaacaggtgctgttttgtagctatttctctgtctgcagagtccagcccaggggctggagcatggcaggggcccctgcatgtctgcaatttgaatgaaagacgagggtactgctcaaacaccaaagctttggtcagagcctaggatgtactgacacaggaccctttgggcagagatatatcacacacagccacaggagagtggttaggaacctggactctgaatgaagactgcctgggttcaagtccaagctctgccacttacaagctgaatgaccttgggcaagttatctcacttccctgggcctccctttcctcatctgaaaaaatggctacattgcagccttgttataaggattgaatgggtgggtgcagtggctcatgcctgtaatcccagcactttgggaggccgaggaaggtggatcacaaggtcaggagtttgagaccagccaggccaacatagtgaaacccgtctctactaaaaatacaaaaattagccgaaaaattaaccgggtgtggtggcacgtgcctgtagtcccagctactcaggaggctgaggcaggagaatcgcttgaacctgggaggcagaggttgcagtgagccgagaccatgccattgcactgtagcctgggtgacagagtgagagactccatctcaaaaaaaaaaaaaaaaaaagaaacttaactgggcatggtggaatccacctgtagtcccagctcctcaggaggccgaggtgggaggatcacttagcccaggagtttgaggctgcagtgagccactgcactccaacctgggtgatgtagtgagaccctgtcttaaaagaagaagaagaaaaaagaatgagtttgtattttaaaagcacttcaatgatgcctggcactctggtgccaggggccaaaggaaaagttagtaataccaatcatttcctgaagactgtgatatttgtttatcatgggtatttttgcattaattttgcattaattttttcattctttttcgtttttaaacatattgcatccaagtgttatttatcttgatgactgggtgtttggtgcctccttaaattttgctcccggggagaatgtctcacttgcctctccctcatcccggtcctggcacctaagaagcaacacatcagttctcatttgtctggagggagctcagcatcattatatgtatttaaagaaaaagatgaatgtgtatatattaccaatacttattcagaatctacaaaactctgagcactggggatgggactgtgtgatggttaataccgagtgtcaacttgattggattgaaggatgcaaagtattgttcctgggtgtctgtgagggtgttgccaaaggagatgaacatttgagtcaatggactgggaaaggcagacccaccctcaatctgggtggataccatctaatcagctaccagcatggccagaataaaagcaggaagatggacatggaaggacttgacttgctgagtcttctggccttcatctttctcccatgctggatgcttcctgcccaacataagactcaaagtcttcagtttttggactcttagacctacaccagtgtttgccaggggctctcggaccttaggccacagacggaaggctgcaccgtctgcttccccacttttgaggtgttgggacttggactgatccactactggcttccttgctcctcaacttgcagacggcctatcgtgggactttaccttgtgattgtgtgagtcaattctccttaatacactccctttcatatacacatatatcctattagttctgtccttctagagaaccctgactaatacaggctgggaatgagacattctcagccacggtctttgacctcaaggagttgacagatcactgattattgttaccacttattgagcatttactgtatgcaagacatggtgctagtgatgtttttattaatccttgtggtgacctttccagaaagaatcattacattcattttacagatgaagaaattggactcagagcaattaagccacttgcctgaagtcatgaagttatgagctggggtcaggatgtgaacccagtctccctatctatctatctatctatctatctatctatctatctatctatctacctatctatctatctatctatctatctatctatatcagggtcttgctctgtcacccaggctgggatgcagtggtgtgatcatagctcactgcagcctcaacaccctaggctcaagcgattctcctgcctcagcctcctgaggagctgggactacaggtgcacacaaccatgcctggctaatttttagatttttattgtagagatgggggtctcactatattgcctagctggcctcaaactcctgtggcaaagtgatcctcccacctctgtctcccaaaatgttgggattacagttgtgagccaccatgcctagccctgtgaacccagtcttttagactttctaccacggtatttgggtaagtccagagctctgtccccatcttctgcaagaacatcttgaaagctgaagttatcagatggatttttctgggagttccattgctgagttcctctgattcatgtctcaggaagctggagtctagacgtggcggggcctgtgggaggtggccctccccttttcagagtggatctgtgcagccatctgccatcacccattcctgtgggggaaaacacagattttcctgtgttaaaaaatctctgagacaagactttggcaggatctgaacagactggcgaagtggctccaggatttcctggaaaaggatgagaagggggaaagagagggcaaaggagaggaggagagagtgggagggaaagaaggaggtcagggagaagaaaaatgagcaggaagagccagcagacagcctcccaggtggatgtctttgaaggtaactgaaatgcatggtggggttttcccaaagggtttctgttagacatttcccactcccagtagggaaactggcttccctaatcagggaagggcagttcagggcagtggagcagtgggtgtcgataatgcccatcttgcagactagttgcgaagttccagtgagattgaatatctgaagtgtagtgttggcacacaataggtattcaacaatgtcagttcagttctctccttttttattttttatttttatttatttatttattttttgagatggggagtctagctcttgtcgcccaggctggagtgcaattgcccaatctcggctcactgcaatctttgcttcccaggttcaagggattctcctgcctcagcctcccgagtagctgggattacaggcacccgccaccatgctcagctaatttttgtatttttagtagagacggggtttcaccatgttggccaggctagtctcgaactcctgacctcaggtgatcttcccacttcagcctcccaaagtgctggggtaacaggcatgagccactgcgcccagctagttctctccttttttaaagacaggctcttactctcttgcccaggctggagtacagtggcacaatcatagttcaccacagcctcaacctcgtgggctcaagtggccctcctgcctcggcctcctgagtagctgggactacaggcatgcaccaccacaccccactaattaacaaattagtggaacgtagtggcaggcacctgtaatcccagctactccggaggctgaggcaggagaatcgcttgaacccaagaggtggaggttgtagtgagctgagattacgccactgcactccagcctgggtgacagatcaagactccatctcgaaataaaaagaaagcaaaaggttccttcattctcctgcctttatccattcactcagcacagtgagcacctaagtgtgccaagcactgtccaaggtactggagatataacagtgaacaaaacagacaaaagcccctgccctcgtggagctgagattctactgcggtaggaaaaagtaaaaaagaaatagataatattataggaacttagagagctgtgaaagctaaggataaacaaagcagagaaggaggatgaggggatgttagggatattggtttcctagttttttctgctataacaaattacagcatgaatctaggggctttaaacaacccatatgtgttatcttatagttctggaggtcagaactctaaaatggatcagcagggctgtatttcttcgggaagctctaggggagaaaccatttccttgccttttctggtttctagaggcttcctgcattccttggatcatggccctacgtcattctgatctacatcactcctcagtctctgaccctcttgcttcccttttataagagcctttgcaattagattgagccatacagataatctaggataatctcctcatctcaaaatccttactttaatcacatctgcaacctcctttttaccatgtaaagtaacattcacaggttctgggtatcagcatgtggacatatttggggagggggtagttgtgaattattctgtctaccacaggaacagagattttagataaggtggccaggaaatagcttatttatttatttgtttttagagacagggtctcactctgtcacccaggctggagggcagtggtacaatcatagctcactgcatccttgaactgtgggctcaagtgaacttcccacttcagcctcctgagtagctgggactacaggtgtgtgccatcacacccggctattttctttttttgtagagacagggtcttgctatgttgctcaggctggtctcaacctcctaggcccaagtgatactcccgcctcagcatcccaaagtgttgggattacaggcacaagccaccacgccttcccagaagaacttattgatgtgacttttgagtagggacctgaaggaagtgacggatagacacctggggagagaaccttccagggagaggaaatgttagtgcaaaggctctgaggagagagtacaatgagtgtctgtgtttgaggaccagcggggaggccagaaaggtcacagcagggagatccaggggcagaaagacaggaactgaggtcaaagaggtcctatgggtgggggtaagggagaggtcatgaaaggccttatagatgattgtgagaaaaatgtcttcctctgaatgagacggaaaaccataagacagtttctctaagcacctgttcaataactgactatgaaagaaaatctgggccaggcacagtggctcatgcttgtaatcccagcactttttgaggctgaggcgggtggatcacttgaggccaggagtttgagaccaccatgggcaacatagggagaccctgtttctgcaaaaataaaaacaaaaaattagcctgatgtggtggcgcacacctgcagttccagctatttgggaggctgaggtgggaggattgcttatgcccagcagtttgaagtttgaggctgcagtgagctttgatggtgccactccagcttgggtgacagaacaagaccttgtgtttctaaaaaaaacccaaaaaaacccaaaaaaaactaaaagagataagtgaaaagagaagtgcaaaatgaggtgtaaacatgtaaaaaggtgtaaggaaatatggaagggacacaattgacaagagaccagaaaattcatagaatgaagtcttcaatgtgtgaagggaaagggctaacataattatgtttcaaagaattcaaacaaatcactaagacaagtccctgaatctgggtagaaaaacaagcaaaggggtgcgaaccgtcaactcactaaagagaaaatgcaattagctaagcacatgggaaaagtcagcctaactagtaatcaaagaaatgcaaattaaaacaacaaaccgttatattttcacctcataaagattctgaaaatgagaatcctggctttggccttggtggaatgaaataggtgcaagaaccctggcagtgggaattggaaatctgattattttgggaaacagtttgacactgggtagcaaaaccttaaacatgggcatcctcattggcccaataagtcaatttttggcaatctagcccaaggaaataattttaaatctggagagagccttatgcattgctgccaaacaggagaaacaactaaactgtgagcaataggttaaataggccacggtgctcattcttttgatatttttgtcaatcatatgaattaggtgccagttatgtgccaggcactgttctaggtgccaggaatacagcagtgaacagaacatcttgaactccttgcccttcatggggttctgattctagtgagggagcaggagagcaaataagaacagatatgaagatgctacatgatgggggacaaagtagggcaatgtcacagagagtggaggggactgcagggtggacaaccaccagtttgctggggacattcagttttaaggctggggcagccctggacaaactgggatgagctagtcacactaagagggtcatccttgtgatgggagtggtcagggtcttgtcctctgaggaggtaggatttggttagggactcaatgcaatgagggagtgaacgatgggagtgctggctgagtaggtttccaggctgacagaacaatacctgcaaaggcccggaggaaggagtgttcctggggcaatgtgagggacttgcacaaggctggagtgtctggggcatagcatgaaggaggatggtggtaagatatagatttcagagagggaaactcttgactcttgcagggaaaggaagaagtttggattttattttaaatccagtgaaagcctatggaggttaagcagggaagcaacatggtaaaatttatgcttttagaaagacgactctggctgctgtgtggagaaggtgatgcaggacaagtaagccccaaagttggggcttagcttgggagggttcttggcttcacccaggaaagaattccagggtgagcggtggtggtggacacttttatttttttgagacagttttcactcttgtcacctgtgctggagtgcaatggcaagatctctgctcattccaacctctgcctcctgggttcaagtgattgtcctgcctcagcctccagagtagctgggattacaggcacccaccaccatgtctggctaatatttttttgtatttttagtaaagacagggtttcaccatgttggccaggttggttttgaactcctgaccttaggtgatccaccccctcccaaagtgctgggattacagatgtgagccaccatgcctggcctagacacttttattgaagcagcagtgcacagcagcagcagagggactgctcctcacagagcagggctaccccataggcagtgtgcccagagtagcagctcagaggcagttctgcagtcatatttatacccacttttaatgatatgcaaattaaggggggatttatgcagacatttctagaaaaaagttggtaacttccgggttgttgggtcattgccatggaaaggggcagtaactcctgggtgttgccatggcaatggtaaactgacatgccacgctggtgagagtgtctgttggaaagctgcttccactttggccctgttttttttttttttttttttttttttttttttttttttttttttttttttggtatttattgatcattcttgggtgtttctcgcagagggggatttggcagggtcataggacaatagtggagggaaggtcagcagataaacatgtgaacaagggtctctggttttcctaggcagagggccctgtggctttctgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttggggataaggttacagattaacagcgtcccaaggcagaagaatttttcttagtacagaacgaagtggagtctcctatgtctacttctttctacacagacacagcaacaatctgatctctctttcttttccccacatttctcccttttctacttgacaaaaccgccgtcgtcaccatggcccgttcccaatgagctgctgggtacacctcccagatggggtggcggccgggcagaggggctcctcacttcccagacggggcggggggcagaggcgccccccacctcccggatggggcagctggccgggcgggggctgcccccacctccctcccggacagggcggctggccgagcgggggctgccccccacctcctggacggggcggctgccaggcggagacgctcctcacttcccagacggggcggccgggcagagacactcctcacctcccagacggggtggcagtcaggcagagacactcctcagatcccagacggggtcgcggctgggcagaagcgctcctcacatcccagatggggcagcggggcagaggcactccccccatctcagatgatgggtggccgggcagagacgctcctcacttcctagacaggacggcggccgggaagaggcgctcctcacttcccagactgggcggccgggcagaggggctcctcacatcccagacgatgggtggccaggcagagacactcttcactttccagacggggtggcggctgggcagaggctgcaatctcggcactttgggaggccaaggcaggcggctgggaggtggaggttgtagtgagccgagatcacgccactgcactccagcctgggcaacactgagcactgagtgagcgagactccatctgcagtgccagcaccttgggaggcccaggcgggcagatcactcgcggtcaggagctggagaccagcctggccaacatggcgaaaccccgtctccaccaaaaaatacaaaaaccagtcaggtgtggcagtgtgcgcctgcaatcccaggcactcagcaggctgaggcaggagaatcaggcagggaggttgcagtgagccgagatggtggcagtacagtccagccttggcttggcatcagagggagaccgtggaaagtgggagacggagacgggagagggagacgggagggggagggggagggggagggcagggggagggggagggagaggggccctgttttatagctagtcttcaatttggtctggtgtctgagccccacctctggagttgagtcctgcctcctacctctaaggcatgttggtggatgcagggtagtgggcagaatagaatcatgtagaccccttagaaggttgttgtaatctagggcagtggttctcaattttaaccatgcatgagcatttcatgcaggggttgttaaaactcagcctcctgcccctggagtctacgtctggagtctgcatctctgactagctcccaggtgatgccagtgctgctggtcctggaccacattttgagtagctaaaagctaggagagagataatggggacttgcagtaaggtggtacccctgctgaggttaggaagagctctggtctgggatgcattttgaagtgaaactatcaatctcatttcagttcccttttaatctgcttacaccaaggagaatagctcaatttgatactagtatgtttctaagacttttctgtattttagctaacagaaagcaggcctcaaagtgtagagcaggctgggcgcagtggctcatgcctgtaatcccagcactttgagaggccgagacaggtggatcacttgaagtcacgagttcaagaccagcctggccaatatggagaaaccccgtctctgctaaaaatacaaaaattagttgagtgtggtggcacatgcctgtaatcccagctacttgggaggctgaggcaggagaattgcttgaacccgggaggcagaggtttcagtgagccgagatcaggccactgcattccagcctgggcgacagagcaagactccatctcagaaaaaaaaaaaaaaaagaatccaatagtgtgatagtggacaaaagaatccaatagtgtgatagtggacatgaaaatacttcatggactacaaagctcttcaccctgctatctgcttcatctttgtggggcaggctgggtgcatcaccagactcctagtcaagtgctctctcttattgttcatggccttgtgttgccccagtcctgggggaggggctgacttttctgcaggactataggaaaggagaatcatagacatatgtccacttgtcagttacctgtgtttccttcttgtgctctgggcagccgatgcactttcctgattgctgtggagcctactaggatctaggaatgaatattgtgcctggctttgggggttcaaaactctccctcttggctcttgagctgcttacttgagcccattcccactctgtggagtgtacttttgcttcaataactctgtgctttctttttgtttgtttgttttttgagatggagtctcgctctgttgcccaggctggagtgcagtggcgcgatctcggctcactgcaagctccacctccagggttcatgccattctcctgcctcagcctcccgagtagttgggactacaggcgctcaccaccatgcccggctaattttttgtattttagtagagacggggtttcaccgtgttagccaggatggtcttgatctcctgacctcgtgatccacctgcctcagcctcccaaagtgctagaattacagacgtgagccactgcatccggcaaatctgtgctttcattgatttactctttcattgctttgtatgttttgtctgagtctttgttcaaactgccaagaacctggacaccctccactggtaacatattttggcgttccagccaggggacaataacgggaaagactccatctatgctacctgatcccccgcttggctgcatcctcaaccactggtatcaatttgaccccaataatctaaggaggaaatgcttgatattcttttgcaatagtttgtccccaatattgcttggaatctggagtttgttgttgaatgggaaagtgggatggtgttgtatgtatccaagcttttgtgctgctgttctaagcagggtcaggcctggttagcatgtggtgctctcttttggtgctgtttggccccggtgttctttggaatttaaaaatcaaactggcatggaaactgctttaccccaaaattttggttcacagccttcactggattacctactggggcaaacagagtgtaaccatgtaaaaccggcgagcttgtattgctatctcatggctagagttccaaggtaaaagccatttggatcttcatttgtgtgcgtgtatacatgtctaaatgtgtttatttgtatgtagacttactgttatatgttgtgcctaccacattggcttataagtaagagagtgcccataacttaataagtccaagcaattttcaagttcacgtgacttaagtaaatctttacgaaactagctagctttaaaattattggtaaatacaaatagaaatgtcttcagaattggcaacatacatttttatctgggttttatgtttttgtctttgctagatattttgaggtgtcaaggctatcaggctgggcgtggtggctcacatttgtaatgccagcactttgggaggccgaggtgggcggatcacctgaggtcaggagttggagaccagcctggtcaacatggtgaagccccgtttctactaaaaatacaaaaattagccaggtgtggtggcatgtgcctgtaatcccagctacttgggaggctgagggaggaggatcacttgaaccagggaggtggaagttgcagcaagccaagatagtaccactgcactccagcctgggtgacagagggagactcactgtctaaaaaaaaaaaagttataaagctattaacccagccaaaacaacaaaaacaaaaaactgtcccttttgcctttggttcactcttggatccagatggaaatctccagctgttctggtgttctggaccaagaagtttgagaaaataagaatccatggacaagaaaattttgaggtagtggttcagagttctggctcgtggcctcagttccaatcctggttctatccttgcttggtgtgaggccttaggaaatctccttgtgtcagtctgggtcctccgagaagcagagcttgctttgagactcaacatgcaaggattttttttttttgagacggagtctcactctgtcgcccaggctggagtgcagtggcacgatctcagctcactgcaagctccacctcccgggttcacgccattctcctgcctcagcctcctgagtagctgggactacaggcgcctgccaccatgcccggctaatttttttgtatttttagtagagacggggtttcaccgtgttagccaggatggtctcgatctcctgacctcatgattcacccgccttggcctcccaaagtgctgggattacaggcgtgagccaccgcacctggcctaacatgcaagggttttgttaggggaaacccttgtgtgaaaggagttagacagtgatgaagcctgactccaagggaggagaagagagaatgttggtggaactgtccgtgctgtgcggtctaaagaaaattggggtttccaaagtcagttgtcaagggcccctgtgttttctaggaatgagctgccttagtttctgtgctgccatacactattgatgggtgagatggattttaaatctagctgggcccttgctctcttatgctccccatagctggaggtcagtggcaggtgcattcttgtggccacgcatcacttaacctctcatgggattgttactacaatcaaatgagacaaggtgtgtaaaacacttggtacaagatctggcataaatactcaacatattttaactattatgattacccagttattctttcgaagccaacaagaaagttttcttctccttttgttatcaaccattccctgcatcagaggctgctaattcagtcagattccctgtaaatgagtgatgtgggccaagtgtaagacattagagagtgggagggactatggtaaactagaaagcacatgaaacatctaaaatggtttgaaaaatagctgggcgtggtggctcatgcctgtaatcctagcactccgtctcaaaaaaaaaaaaaaaaaaaaaaacccaacccaaaaccaccccaaaaaccccagtgaggttgattttcccacccccccaaacccattaataaatttgttgtgtatttgacgacatggagagacctggctggttgatttctggttttgtgcacagcttcagtgttgtcttttctgagaggttttgaatgtggacatcgggattggatggcatgggttgggatcttggctctcccacttgccagccatgagatattgggcaaattatgaaatctcgggcaaattatgaaatttcctggtaactcagtttttccatctgtaaaatggggataataatgattctcccctcatgaaatttcaatgaggatttaatatacagaaggagtttaggacagtgtctggaacatagtaaggctgagtaagtgttgatgttattctggggttgagagaaggagcaagaacaaccttgggttgctggaggctctcatggtttttcctcatcatttcattccacttaagcctaaaacaatatgatcggtataacacccagacaggaatgagtttctcttataccggtgatataatcatatataataatgccacttacataagcttccttagctccttgttaaggccacccacactccgttccacttcacactgttaaggaatgtttctcccacagggaaaaagacacccagctctatgctaattaccactttaaagcagggaccaaggggtgtgagggggggaaaccagcaaaggtgtctttggcagtgctcttgatttgggagagtaaagtctttagtttggaagcagtgagtcaggcctggggacctcagaggagccagaggcaacccatggtgtcccccagattaggcaggcccaacctacgccttaggtgaaaagtgtctgtgagccagccctctgcagacaaatgctaatctgccatttcttttattgcttaaaaaaagagagtctgagacatattctacgtgtgatacaagctcattgtggaaaatatggaaaatagatgggaacaaaatgaaagtgtaaaagtcagaagtcatgagcgatgaatatagtcaagctaacagaaaaaatataaaaagtcagaactcattcagctgaaagtgtcagaaatcaattgcaaactggtttagatgattcaagagaatatattggcccacagaacaaggctgtcacagaggtggatcaggcatggctgtatccagggctcaaacgttattagcggaatgccatcttgcttgctctgtctctatttcatgaataggccttctccagatggtggaaaaggtagacattatcaattccagattaatctccaccaactgaacaatgctactagaaaggaagaggctcttcccagtgctcagataggaaagtctcagggagggacttgattggctgaagatgtaccacgtgtgcatccttgaaccagtccctgtggttggggatgtaccacctgtgcatccttgaaccaatccctgtggttggggatgaggtgctctgattggccagatcagtgagtcaatggccaggggagatgaaatcaaggaatggtccacttaaataggtcctccacagggagtggtgattctgttccaaaagaaagagaaggaaatgaattgatgaaaacaatggatattgctatataagaagcatataacatctgtaatcccagcactttgggaggctgaggtgggcggatcacctgaggtcgggagttcgagaccagcctgaccaacatggagaaaccctgtctctactaaatataaatatatatatatttagctgggtgtggtggcacgtcccagctactcgggagactgaggcaggagaattgcttgaacctgggaggcagaggttgctgtgagccaagatgacaccattgcactccagcctgggtaacaagaacaaaacttcatctcaaaaaaaaaaaaaaaaaaaaaaaagaggtcaggtgcagtggtcacgcctgtaatcccagcactttgggaggctgaggtggtcggatcacgaggtcaggagatcgagaccatcctggctaacatggtgaaaccctgtctctactaaaaatacaaaaaaattagctgggtgtggtagcgggcgcctgtagtcccagctactcgggaggctgaggcaggagaatggcgtgaacccgggaggcggagcttgcagtgagccgagatcgcgccactgcactccagcctgggcgacagagcaagactctgcctcaaaaaacaaaacaaaacaaaaaaaagagaagcaaatgacaagtttccaatacttgcaccatctagaaataatgactgttgacttcttaatgtaaatcctcccagaattcacttccccttatttagctatacttataagcatatactagatacatagaacattgagatatcctatgcaaacttttgtaagctgattttgattgccttgtttaaaaatatcatttagatattttgaaatataagtggcatatcttctgggtagaaaaattagagaatatggacaaacaaaaataaaataactttttttaaataatttttttttttgaaacagagtcactctatcacccaggctggagtacagtagcatgatcttggctcactgcacctccacctcctgggttcaagcgattttcatgcctcagtctcctgagtagctgggattacaagtgcatgcaaccacgcccagctaatttctgtatttttagtagagacggggtttctccatgttgtccaggctgggattgaactcctggtctcaagcaatctgcctgcctcggcctcccaaagtgctgggattacaggtgtgagccaccacacctgatctaaaataacttataattggctggggttaatagtaagacttttaagaagccagattaagggcagggttgagatagaggaagaataatttgtcagagctcctcttatgataccctgtagtccctctttgcagtgctttgcacatttgtaattttacattaattactcaaagtggcttatttaaaataattttattctctaagtgttgctttccttaaaagaaataagaaaaaaaacccagaaaaaaagtgacctaaaataattttattctgaactatttcaggcacacaaaaaactataaagaccagtacagtgaacaaccatttacccgtcactcagtttaaaaaatataacaaagacaatcaagtccttctgtggacccctcttaatctcgtgctcctttctctcttccttccttcccaatgggatctctatcctgcagttgtgtcttatatttcatgcctattttgtattcttattgaatatatgttatccattatcaacatataacattatgttgcatatttaaacactttaagtagactaccactgtatgtattgttctcatggcttgctttttggttcattgttatgattttgcaatttatttttatttttatttatttatttatttttgagacagagtttcattcactcttgttgcccaggctggagtgcaatggtgtgatttcagctcactgcaacctccgcctcccaggttcaagtgattctcctgcctcaacctcctgagtagctgggattacaggcaggcgccaccatgcccagctaattttgtatttttggtagagatggggtttctccacgttggttaggctggtctcgaactcccgacctcaggtgacccgcccgccttggcctcccaaagtgctgggattacaggcgtgagccactgggcctggccgattttgcaaagtgttaatgttgatacaggttatgtttcatttattttctactattgttagtgttaatctgttagtactagcatccatggtagaactcaatcataattaatctatctattctgcagatggacatttaggttccttttttttttttttttttcttgagacagagtctcgctcttttgcccggctggagtgcaatggcgccatctcggctcactgcaaactccacctcctgggttcaggtgattctcgtgcctcagcctcctgagtagctgtgactacagcacccaccaccacacttggctaatttttgtatatttagtagagatggggttttgccatgctggccagggtggtcttgaacttctgacctctggtgatccgcccaccttggcctcccaaagtgctgggattacagtcgtgagccactgagcctggccgtctcccttcccttcctttcccttcccttcccttcccttcccttcccttcccttcccttcccttcccttccctcccctcccctcccctcccctcccctcccctccatctccctctcctccccttccttctttccttccttccttccttcctctttctctttctttttctctctttctttctctccctctttttctttttttcttctttcttttttttggagacagggtcttactttgtcacccaggctgaagtgcagtggtatgatcatggctcactgcagcctcgaccccccaggctcaagcgatcttcccacgccagccttcctgagtagctgggattataacaggcttgcaccgctatgcctggctaatatttgtattttttgtagagatggggtttcaccatattgtccaggctgggcttcaactcctgagctcaagcaatccacccaccttggcctcccaaactgctgggattataggcctgagccaccgcacctgacctgtttctatttttctattacaaacagtgctgtagtaaatattcctgtacaggccaggcacggtggctcatacctgtaatcccagcactttgggaggccgaggtgggcagatcacctgaggttgggagtttgagacagcctaatcaacatggagaaaccccatctctactaaaaatacaaaattagccaggtgtggtggcgcatgcctgtaatcccagctacttgggagactgaggcaggagaatctcttgaacctgggaggtggaggttgcgataagctaagatcacaccactgcactccagcctgggcaacaagagcaaaacgccatctcagatatatatatattcctgtacatttctccttgtgcaaactgatagagcttctcctggtctagggtatgtacctaggagtggaattgctgggctgtgggggttatacttcttcaactttactcaatttcaccaagttgctctgcacaacagttgtaccaatttacactcttacctgcagtacatgagaattccagtttctccgacatttggttttgtcagactttttatctttgccagtttgatgtgtgtgaaatgcagtctgctggcacccagtgttcaatcctgaagagctggatgcataggtcttgttcaccatggttcccccagcactttgcgcagcacctgaaatatagtaggtattccatattttttggctgactaattgagcagcagttttctggctcctctcatgtaaaattccattacaatttgttggagaagccatttgttctgcagggagtcctgttttcatctcactcttcccaattcaaaaccaggaaaccgggccaggcgcagtggctcactcctgtaatctcagcactttgggaggccaaggcaggtggatcacgaggtcaggagttcaagaccagcctggccaatatggtgaaaacccatctctactaaaaatacaaaaattagccgggtgtggtggcatgcgcctgtagtcccagctacttgggaggcagagacaggagaatcacttgaacctgggaggcagaggttgctgtgagctgagatcgccccactacattccagcctgggtgacagagcaagactccagctcaaatcaaccaaccaaccaggaaaccactcagggactaagcagagaaaacagcttttgattgccctgtttgcctttttgttagaactgcagttctcaaaactttcccatacctcagaaccacgtggagggcgtgttaaaatgcaaatcgctgggatccatccccccagaatttcttgttcaggaggtcgagggtaaggtctagggatctgcttttttttttttttttttttttttttttttttttgagacagggtcttgctctgtcacccaggctggagtgcagtggtgcaatctcggctcactgcatcctcgacctcttgggctcaagccatcctccccactcagcctccctagtagctgggactacaggcatgtgccaccacgcctagctaatttttgtattttttgtagagatgagtctctctatgttgcccaggctggtctcaaactcctgggctcaagcaatccacctgccttggcctctcaaagtgttgggattacaggcatgagccaccatgtccaaaataagatttgcgtgtgtaataagtacctgggtgattctgatgctggtgctgctggtctgggaactacactttgagaaccaccggatctgaggaacattcaatccagacattttggatatgatcaatgtggagtgtccttaaagagactgaatgcaaaacttgaaaagccactcccaaagtgtagagtggagggaagaatataacatctaactccacttagccggagtaggaaaaggagaagtctggaatgtttaagacagttggcagcatttatagagactgatataattcagtaagaatatattgggcaccaactgggttgtttccttccttcttctcttctcttctcttctcttctcttctcttctcttctcttctcttctcttctcttctcttctcttctcttctcttctctctctctttctttctctctctttctcccttcccttccctgcccttccctcccctcccctccccttcctttcctttccttccttcctttccttctctcctcccctcccctcccctccccttcccttccttttttttttgacagagtctctctcttgtcacccaggccggagtgcagtagtgcaatcttggctcattgcaacctctgcctcccgggttcaagcgattctcgtgcctcagcctcctgagtagctgagactacaggtgtgtgccaccacacccagttaattttaatttttattttttgtatttttagtatagatggggttttgttatgttggccaggctggtctcaaactcctggcctcaagcaatccacctgcctcggcctcccaaagtgctgggactacaggtgtgagccatcatgtccggccctgactgggttgtttccatctgctcgcaagtcttctacgtgctttcaagccaggatctttttttccattgatacttactcctgagatcaccgcaatcttctcttcttcctctacctcctccccttctcccccccccccctcctctcctcctcctcctccttcttcttctttttcctcttcttccatgaattaaattcagatgtggacttggctatgtgttgaaactataataaagatagctagcatttattgaggtcttggttgccaaatgcttttgttagtgttatctcacttcatcctccctcagacttcaggagataggtaccatagttacatccactttgtggatgaagtttagaggttacacagcaggtaaataacaaagctggggctgcaacccaggtcaccccaattccaatgtcttgttctttactgaaactatgtaccatacatctgtgattcttagcttccttattaattaattcaccaaatgttttctgagcacctcctaggtgctaggccctttgctgctgatatgggcaaatgagacagacaaaattcctggtagcacgacaatatgttttggccctgtgtccccacccgagtcttatctcaaattggaatccccataatccctaagtatggagggagggaccaagtggaggtcattgaatcatgggggcagtttccctcatgctgttctcgtgatactgattgagtgctcatgaaatgtgatgatattatagggcagtttccctgctcctgctcattctctctggcctgccaccatgtaagatgtgcctacttccccttcccccatgattgtaagtttcctgaggcctccccagccatgcagaactgtgagtcaattaaacttctttcctttataaattacacagtcttgaggctttctttccttttttctattttgtgagacagagtcttgctctgttgcccagactggagtgcagcggcatggtctcagctcactgcagcctctgcctcccaggttcaagcaattctcctgcctcagcctcccgaatagctggtattacaggcatgtgccaccacacctgggtaatttttctgtatctttagtagagaggggtttttgctatgttggccagtctggtgtcgtactcctgtaatcccagcactttgggaggcttgaggaaagtggatcacttgagtatttctttatagcagtgtgagtcatctcctattactgtttttttttttttttttttcaaaaagatgggatcttgctgtcacccaggttggagtgcagtggcttgatcatagctcactgcagtcttgaccttccaggctcaagcattctcccacctcaacctcccaagtatctgggacaacaagtgtgtgcaatcatacccgcctaattatttgtttattttttgtagagatgaagtcttgctatgttgcccaggctgttgtagaactcctggactcaagcaattctctcacctcagcctcccaaagtgctgggattataggcatgagccactgcgctggccacaatctcctattactctcatctatagaaggaaatgagactatccctctttgagggttgctgtgaggtttagggaaatgtgctcttggtacccagtagatgctcaataagcattacgctaggtatatagtaggtgctcaataagtgttgtgcttggtatatagttagtaggtgctcaataagtgttggctcctgatttccttcactcccaggagctggtaactctctatttgtgtacgtgggggagaatgaagccaattccaagagactacgatgttctcctagaaaaaggcattgcaccatctttaacatttgtgcagcccaccctctattagctcatctgagcaaatgcttattttcctggtctctggggacaagacttaggctcttttcatttgcctcctcaccctctccccatctccctattctagccagtatcacagaatatgcaacatcttgacaaaccaaaggcactgggcaatgctttaggaaactgtgcaatttagagagatgaacaatgaagaaatatcagctctaggcagcttgtgtgatggaaaataggagaagataagataaatgtgcagcttagaagggagagttctcacaggtaatgagagaaaatcaggagccaacatctatttagaggtattttccttcaagcatctggagcttttgaagaacctggataggagaaatctacattttaggagtgtaggctattttgtaatttccatctttgaaggcttcaactccatctttgctgtctgtgtgctagttatttctttttcaggctcaattttaataatttccttttttttcttttctcccaggaagagggtttaactctgcaacataatcagtgcacagaaacctaaattggaaatctctttcactacagacaagacagttcagaagtgaaaagtcacagtaaaattgggcatttctttccatagacttaacagaagcaacacctggattccagcagctgtactggtgtaactggcacttgaacgtctccatccaagtgcccctttgtggcagatgaagagttcaggttttgttcctcatcagctttgtgaccttgggcaaagtccttgacctatcagagcctcaatttccctatctgtggaaagacgaccatgaaaaaatatgcactatggggtggttctggtggggagagttaaattagatataatttagaaattcttagcataatatttgtatcatatatatgtttatatatgttaatatgtaacacataatagtatataagaaagtcatctatatgaacttcacacagcatattatattatatatacacactacatggtgtatatgacatatactatctaatatatgatatggtttggctgtgtccccacccaaatcttatcttgaattgtaaatcccacaattcccacatgttgtgggaggaacctagtgggagataattgaatcatgggagtgggtctttcctgtgctgtttttgtgatagtgaataagtctcatgagatctgatggttatatacacgggaatttccctgtacaagctctcttctcttgtctgctgccatgtgagacatgcctttcatcttctgccatgcttgtgaggccttcccagccacagttccacgtggctggggagtaataaacctctttcttttgtaaattgcccagtctcaggtatgtctttatcagcagcatgaaaacagattaatacaatatgttatatatatattatatagtatgtatctaatatagtatagtatactaagtattaaatattttataataaatataatactatagcatataaacatgagtacaatgatatatgctctaacatatgtactatgtaacataatggcacatacacatattataccatgtttgtattttatagtgtacataacatatactatatatcatatagtattctatagtatatatgatatacataccatataacacaaactataatatatgtactatatacactatatataatatagtatactatgtaatatatgctatatatacaagcaactgtcctctaaactatatcttatattatatattatgtaatataccaatataatatagtagagatgaaagtttcttgtgaattgaaaagccatgattaataaaagatgttattattcatatagagatatagatgactgataaggtttgtggtatgaccctgagtctctttttttctatcatctgcttgattcactacctgactcttaatttttctttctttctttttttttttttttgagacggagtcttgctctgtcacccaggctggactgcagtggcgtgatcttggctcactgcaagttccgcctcctgggttcacgccattctccgtcctcagcctcctgagtagctggaactacaggcacctgccaccatgcccggctaattttttgtatttttagtagagacagagtttcaccatgttagccaggatggtcttcacctcctgaccttgtgatccacccgccttggcctcccaaagtgctgggatttgagatggagtctcactttgtcacccaggctggagtgcagtggcgtgatcttggcttgttgcaacctccactttccatattcaagcaattctcctgcctcagcctcccaagtagctgggattacaggcatgtgccaccatgctcggctaatttttgtatttttggtagagactggtgttcgccatgttggccaggctggtctcgaactcctgacctcaggtgatccacccacctcagcctcccaaagtactgggattacaagcgtgagttaccatgcctggccctgactcttaatattttattttactgttttttcctcaactacttcttgttgcctttgtcattcggttaacgggccatcctcctctcaggagggccaccaaagggctgggagtcaccactgacacattgaaactcttttcctccctcctgctctacactcaccctacatctaacactctggctgcctctactgatcctggctctaaagcatggcctggatacatccactcttttctgagccccatcaccccatgccagctccccccacctgtctagacaactacaatagtctcttaactactctccctgcttcctccttcacctctttataatccactcttcacgtagtagcctgcgtgatcttttttttttatttttattttttttgagacaggatctcactgtcatccaggctggagtgcagtggcacaatcgcggctcactgcagcctcaacatttctgggctcagatgactctttttttttttttgagacagagtcttgctctgtccccaggctggagtgcagtggaacgatctcagctcactgcaagctccgcctcctgggttcacgccattctcctgcctcagcctcctgagtagctgggactacaggcacccgccaccacgcccggctaattttttatttttagtagagacggggtttcaccatgttagccaggatggtctcgatctcctgacctcgtgattcacccgccttggcctcccaaagtgctgggattacaggcgtgagccactgcgcccagccttgggctcagatgattctcccacctcagcctcctgagtagctgggaccacaactaatttttgtattttttttttactttattattattattattattgtggagacagggttttgccatgttggtcaggctgatcttgaactcctgagctcaaacaatcctcttgccttggcctcccaaagtgctgggattacaggtatgtgccactgtgcccggccaatctttaaagggagtaaatcggatcatgttacctagctgaaaacccttcattggtttttccaacacatgtagcataaattccgaactccttactgtcaatttttcctgaaatgtacctttgcctggatcactcccctgctctgccttgcccactctgctcctgcactggtgacagttcagctttcaaacacaccacactcaatcccaccttgtggcctttgcacttgctgtttccttgcccgggaatgtctttcctccaagatatctgcatggccctcttgttcactccattcaggactctctgcaattgttgctttatctggggggacattcctgatcatcctaacaaaaataacacctcccatcacttgtgtcttcttaacgtatcttgccatacatacatacttagcatttaccatatactctctggatatatatatatatatatatatatatatatatatatatatatatatttagcatttttacattctctgaaaggccccagagcgcttagtgtatggcacaaataggtaaataatggtaataattattactattcattttgttattatagacagtgctgtgtgagttttaaatcctttcatgagaaaaggtttttttaaggctgggcaaggtggctcatgcctctaatccagcactttgggaggctgaggcaggtggatcacctgaggtcaggggtttgaaaccaacctggccaacatggtgaaactccatctctactaaaaatacaaaaattagccaggtgtggtggcgcgagcctgtagtcccagctactcgggaggctgaggtgggaggattgcttgaatccaggagtcaaaagtttcagtgagctgagatcacaccattgcactccagcctgggtgagagaacaagactttgccccgccgacccccgccagaaaaaaaagttttttttttttttgagacagagtctctctctgtcaccaaggctggagtgcaatggcatgatcttgtttcactgcaacctccgcctcctgggtttaagcaattcctctgtctcagcctcctgagtagctgggattacaggcatgtgccaccacacctggctaatttttgtatttttagtagagacggggtttcaccatgttggtcaggctggtctcaaactcctgacctcatgatctgttccccttggcctcccaaagtgctgggattacaggcgtgagccaccgagcctggccctgttttttttgtttgtttgttttttgttttttttgtttttgttttttgtagagctgtagttttgctatattgcctaggctggtctcaaactcctggcttcaagcaatcctcctccctcggcctctcaaagtcctgggattacaggattgagctgccatgcaagaccaagaaaccgttttgatagtcagaaattatatagctaccatttatggagcttaactatgtgccccgcaggtgctaagttgttttttttttttttcaactctgtctcatttaactctcactatcacagaatgccttgaagtttgtattactgcaggagaggaggtgaactcaggatcagctttattaatattgataataatagtagtgttattaaatgaatgaatgaaagcacaacatgagacctattctaaggtgattagaagactaagcactcagctctgggattgaatggtggaggggcaggcagtttggaaggggaggcatcccttgtgtactcccaggagtgtccttatccagggtcaaccttggaggcaccaagatttattttattagagaaggcagccattcctcaccccgcactacccacagatccaaggcctgaggaatctgagaaatggcccccctagtccataggctcaatctattttcactgggagagaagcagcccaggcatatggggtctgcacctttcactgcgtaggtgataaaccttgagccaaatcagaattatcggtcttgtgttctgtcgtatggggcctcccaacactgtgaagtgcactcacacccacgtgcccttttatttatgacttttattgagccttctatgaagtcgtaaattgaccaaccctccaactggttccggccctcatcaggaagctatcatcaaagtgaatcaccttctcactggccacttgttccctgaaggttcattgcaaaggctgagatgttttctgggacttcttatagaatctgtcagccctagcttagaactgccaagccaaggtttttttgtttctgtttctgtttttttttttttttttttttttgttgttgttaagaaagagaagtaaaatacaaagtggaaaggtaatgtgtttgtttggccagggcctctcatctctgtacagtattctggaaatgcctcaatttctggagctgtggattggacgaggttgacctactcttattctggcctagaaaaagtctgagtaattcttgcatcagggaggccaggcatgttggctcatatctgtaatccagcactctgggatgctgaggcgggtggatcacctgaggtcaggagctcaagaccagcctggccaacatggtgaaaccccatctctactaaaaatagaaaatattagctgcgtgtggtggcagaagcctgtaatcccagctacttgggagtctgaggcaggagaatcccttgaacctgggaggtagaggttgcagtgagccaagattgtgccactgcactccagcctgggtgaaagagcgagactccatctcaaaaaaaaaaatatgtgtatatatatatatatattcttgcactagggatttggggacaaggcagagaacaacatattcctaagggaatatgggaaccagcaacttaaataaaaacaagggttggatcttggacgtaggagggacttgggtggaaatgatttccctaaaagcacagggtgctagagagtccctaagaactcctcagacacctctcaagccctgtgctggggaaacaacctgcattatctcatctactcttcagcaggcctctgtttcatctccatttcgcagatggagaaattgaggctcacagaggttatgtcactgtataagttgctctagatcacatggatactaaatggtagagccaagttctgaacacagattcttctttaatttattaaaattcacccatttggatgtgcatgtcaataatttttagtaaatttatttcgtttcattttatttcatttatttatttatttgagatggagtctcattctgtggcccaggcttgactgcagtggtgcagtctcggctccctgcaacctctgcctcccaggttcaagcgattctcctgcttcagcctcctgagtagctgggactataggcacatgccaccttgcctggctaatgtttgtatttttagtagagatggggtttcaccatgttggccaggctggtcttgagctcctgacctcaggtgacccacccaccttggcctcccaaagtgctgggataacaggcatgagccacttattttattttattttattcttttgagatggagtttcacttttgttgcccaggctggagtgcaatggcatgatcttggctcactgcaacctccgcctcccgggttcaagtgattctcctgcctcagcctcctgagtagctggattacaggcatgcaccaccacgcctggctaatttttgtatttttagtagagacggggtttctccatgttggtcaggctggactcgaactccctacctcaggtgatccgccagcctcagcttctcaaagtgccaagattacaggcttgagccaccatgcctggcccacttattattttgtaaagagacagggtcttgctctgttggccaggctggaggacagtggcataaccgtagctcactgtagtcttgaactcctgggcttaagccatcctcctacctcagcgtcctgagtagttaagactacaggcatgggctaccatgcccagctaatatttttagtaaattttaaaagttgtgtaattatcatgacaatacagtcttagaacctttccatggtgtccagaatgacccctggtgctgatttgccgtcaatcctcattcccatctgtagcttcagttgacaactgtgcctgggcctgtgtgtctctataaatttacctattccggacatttcatataaatagaatcacacaatatgtagtcttttcatttgacttcttttgcttatggtgagataactatgttgttttgtatattaacagttcattcctggctgggcgtggcggttcacgcctgtaatctcagccctttgggaggctgaggtgagtggatcacttgaggtcaggagttcaagaccagcctggacaacatgggaaaaccctgtctctactaaaaattcaaaaagtagccaggtgtggggaacgcacctgtaatcccagctactcagggggctgaggcaggagaatcacttgaacccaggaggcagaggttacattaagccaagattatgccactgcactccagcctgggtgacagagtaagactctgcctcaataaaaacaacaacgacaacaacatagttcattcctttttattcctgaatattattccaatgtttgggtataccccattttatttattcattttaccagttgatgagcatttggattatttctatttcttggctgctataaagagttctgctatgcacattcatgtgtaggtttctgtatggtcggatgttttcatttcatctgggtagtttcctagaagtggaattgctgggttttatggtaagctcatgttaaactttgtaagaaactgcgaaacttttcaaagagcctttgtcattttacattgaactcaggtctttgtgactctgacgtccaagttcttaaccactgcattatgtgtatgtctcatgttactccatgccatgaataatcaattcattttgacaattattgcttgatgtttattctatgctggtcgtggtactaaatggtaggaatagagaaatgaaaggatatggcttgttttctgccttttatggtagattgggttattattattattattattgttattatttttgagacagagtctcactctgttgcccaggctggagtgcagtggtgcgatcatggctcactgcagcctcaacattctgggctcaagtgatcctcctatctcagcctcctgagtagctgggatcatggcatgtgccaccatgcctggctaacttacacttttttttttctttgtagagacaaggtctcactgtgttgcaaagactggtctcaaactgctgggctcaagcaatcttcctgcctcaggctaccaaagtgctggggttacaggcttgagccacctagcctggttagattggttagtgatcacaatttttctaccatatgacctttcagtgtaccagatggacagagcatatttccccacccatattaggctgttcttgcattgctataaagaaataccagaggccacgcatggtggctcacacctgtaatctcggcactttgggaggctgaggcaggcggatcacgaggtcaggagatcgagaccatcctggctaacagggtgaaaccctgtctctactaaaaatacaaaaaattagccaggcatggttgcaggcgcctgtagtcccagctacttgggaggctgaggcaggagaatggcgtgaacccgggaggcagagcttgcagtgaaccgagactgcgccactgcactctagcctgggtgacagagcaagactccatctcaaaaaaaaagaaatactagagactggataatttataaagaaaagaggtttaattggctcacagttgtgcaggctgtacaagcatggagctggcatctgcttggcttctggggaagccgcagggagcttttactcatggcagaagtgaagagggagcaggcacgtcacatggcaaaagcaggagcgagagagagagtgtgggttagattctacaccctttttttttttttttttttttttttttttgagacagagtctcgctccagcaccaggctggagtgcagtggtgcgatcttggctcactgcaacctccgctttctgggttcaagccattctcctgcctcagcctcccgagtagctgggattacaggtgcgcactgccacgccgagctaattttgtatttttagtagagacagggtttcaccatgttggtcaggctggtctcgatctcctgaccttgtgatctgcccgcctcggcctcccaaagtgctgggattacaggcgtgagccaccgtgcgtagcccacacacttttaaatgaccagatctcatgaaaactcactcactatcgtgaagacagcaccaaatcatgagggatctgtccccgtgacccaaactaactccaccaggctccaccttcagcactggggattgcaattcaacatgagatttggctggggacaaatatccaaactatagcaccaccccatggtgttgggtttgcccatgtgacttgtggccaaggaacatgaatcagatatgatgcaaacagatgcctcacatgtgctttttgtgctgtagttcatgttcttgtgttctcctgatccattatgagaagaacacactctgcatagcggtttcttctttagtctgagagtcacagcaaaaatatgtgaggcagacctgaatttaacacacagcctaaagctaagtgcaggtttcccacagcatgaagtagacctgcccatctgatccctgcctagatcagttaaattgtagtcatcctactgatcactgagagttttcagaagtgtttgtcattgtaaacaactgaaatattagttgtttgttatgcggcaatagctgactaatgcatctttaaagagcctatataaagagatacacagaaatataaagcaatctataatagagagtacagtgaatgtctggagagagacacaaaatgagtactgtgggaaaccactctggtggtaagggtaaaattcagcttcatgaaaaaggtggtcttaaaggataaggaggattttgacaggtggaaatgagtgcagtgggatgtcatctaagcaaagaaaacagcataagcgaaggcctgaaagttttatacctccaggttttatgcctatctatggctcatgtcctgtgatctaagtttctcagaagacagagatgcatccactttcagggtgaggacctttagcttgtcacttctggtcatccctccagaatgagccgtttgcaatctttatgttagatctaaaatccacaggagcttagtgacagacattgatggctgttgctactgtctagatctggtcatggacgtgttccaccacccacagactcaccaccaccaccaccatatcgaatttaaaaatgagtctcttaaatacttaactgacttatcttgccaactcccattaaccagttttatgcctacttctctggagtgacaaccagataatgattatagggaaatttgtttttacttttcttttgcgtctgctgctttctttttgttagaatttttgtgatatacatttttgttttcaatgtttctatgttgtcttgttttatttgttgtttattgtattgcatagtcttgtctacagtatttaactggattttttttaaaagaagcactccaaactgaaaggcattgtcttttattagagaaatttaacccatttatgtttattgtgcctattgataagtttgaatttactcctgatatttcaaattccaatttaccatgttttaaaaattgatgcataataattatatattattatgcatcaattatgcaaaatatcacatgtatgaggtacatgtgatattttgatacgtacatacaatgtgtacttttcaaatcagggcaattaggatattcatcacctcagacatttatcatttctttgtgttgggagcatttcaaatattctcttctggctatttgggtatgtacaataaattattgttaactatagtcaccctactgtgctgttgaactctagaacttttccttctaactgtatttttgtacccgttaaccaacctctcttcacccctcactcacccccccaccctctggtaaccatacttctactctacttttatgagatgaactttttaaggtcctacatattagtgagaacatgcaatatttatctttttatgcctggcttatttcccttaacgtcctccagtttcattggtgttactgcaaatgacagaatttcattcctttttatggctaactggatattccattgtgtatatatattatattttgttttcttttcttttttttttttttgagacagagtttcactcttgctgcccaggctggagtgcaatggcacaatctcggcttactgcaacctccgcctcccgggttgaagtgattctcttgtcccagcctcctgagtagctgggattacaggcatgcgccatcatgcccagctaattttgtatttttagtacagacggggtttctccatgttgttcaggctgatctcgaactcctgacctcaggtgatctgcacacttcggcctcccaaagtgctgggattacaggcatgagccaccacgcccggcatatactacattttctttcttcatccattgacgaacacttagtttgattccatatgctggctattatgattagtgctacaataaacatgggtgtgcaggtatcttttctacatattgatttcctttttttggatatatacccagcatggaattgctggattatatggtagatctatttttagttttctgagaaatctctgtactgttttccataatggctgtactaattgtcattcccaccagcaatgcactagtgttgccctttctccacattctcaccagcatgttattttttgtctcattgatactagccattttaactggggtgaaatatctcgtaatggttttgctttgcatttcccttgtgattagtgacattgaatatttttttcatatccctgttgtccatttgtatgttttcttttgagaaatgttcatttaccctgttttaaagtttgttctttttctttcctgcttttttttccccctgttacattggttatgttttccttgatgcattttttttcttcagtggtttggaagaaatgcacgctagttctgtctctttggcaattatctttgacattttaaacacattatgaaacatactattctttcaaagtatagagttaattaggatttcatccggagcaaaagaacaagcagcatgttttcacttctctaccttagccatctgctgctatttcctacgttgaaatgatctggaactttagtttcagaatgttatttatgtacttatttatttttattgtggattcagggggtacatgtgcaggtttattatgtgggcatattacataatgctggagttttagcttctattgaacccatcacccaaacaatgaatatagtacacaacaggtaatttcaaccctttcccaccttccctactcccctcgcagaatattactgaaaacaattttagattttgtctgtttttccaaagtatactctttctggccaggtgcggtgactcacgtctgtaatcccagcactttgggaggctgaggctggcagatcacccgaggtcaggagtttgagatcagcctggccaacatggcaaaaccccgtctctactaaaaatacaaaaaatagccgggcatggtggtgcacgcctgtactcccagctcttcgggaggctgaggcaggaaaatcgcttgaacctgggaggcggatgctgcagtgagctgagatcacaccactgcactccagcctggatgacagggcgatactccatctcaaaaccaaaaccaaaaccacaaccacaacaacaacaacaacaacgtacgctctttcagaaagtctccgagttgaaaacgcctgtgtggccttctagcatccagtgttaccaacgaggaatatgctaccgatctgctacttcatcccttagtgaggtttttttttttttttctcttaggaactttttaggatactctgttctcactgaaattgcaccctgttgcaactaggtgtggttcttttccatgtcagattggtcttatttatagaatacatgatctgctcttagctctttgaagctatcagttatacttacattaaaatcttttgtttgtttgtcctattgtagtgattaagcatgtgagttctagaatcacaatactgggcttgaatcccagccgtgatcctttctggatatttgagggaaatttctgtagttacagcaggaacagaggtggggtgattccagattccagtattctaggcagaggcggcacttagcagaactagccctggtggaggtggccctctgataaattcagagctgatttatcagcagtgtcttcaatggcacaatgttagatggaggctgatgggttccagcctaggagcattagcagcttctaaaaatttattatttttatttttttaaacaaattattattattatttttatagaaatggggttgccccatgttgcccaggctggtcttgaactcctgggcttaagcgatcctgcctcggccccccaaagtgctgggattataggcatgagccacagcacccagcccattagcagtttttgatctacggttatcacgtcttctttttgctcctcagacccacccacttttccaattgctcttccatccatctccaaaccttatacctaactccttggtttgaaatatctagagtggtttctgctttgctgataccactggtttctgaaacatgagcataggacataattgatattggggtgaatgggaggaacagaatgatgcaaaattgtctgcttctgtgtatgagaaagacactggccaatcttaattctgcaagcccaggagggctcttaaattatatttattattattattatttttgagacagagtttcactcttgttgaccaggctggagtgcaatggcacaattttggttcactgcaaactccacctcccaggttcaagtgattctcctgcctcaacctcctgagtagctgggattacaggcatgtgccaccacgtccggctaattttgtatttttagtagaaacagggtttcgccatgttggccaggctggtttcgaacccctgacctcaggtgatccacccacctcggcctcccaaagtgctgggattacaggcatgagccactgtgcctggcctgttattattagtagtagtagcataatgcattgaacatagcttgtcaatgcttgggtgtcaggtaatcaacaccaagacgtcccttgagacttttgctttctaatttgccctgaggataggccaaaataagctagtgacatattgagttaattgggcatcaacccaggaattctgcttcttgctgtcctaccctggacttccccatgaagttagtggccccaggaggaaggtgagaaaagggtgaagctgcattacacttgcagtcagtgttcaagtcaccacaaaacggtgacctacctacacagtgccctgaatcctccagtcttgccccagatgacagaatccacatggacccttttactgaagcccgtcaggctccgcggttttatagatgatgtcaggaggagtgattaggaccaaaggaaaaaggttcctaggcacagttgctaaaactgtgctcctgaggtctgtaggagcccccaaggtctctgttgattactttaagcaaagctcttcagtttctctgtggggaacttctccctaagtgaccacaatcaggttagcaggtggctgagtaaacaaggctgaacaatgggttttccgtcaagttggtttatatcagcaagaagccctaaatctgttttttttttttttttccagtccctcctggagatgaagaaagagttcagtcaccctgctgaggagagaaaaggccattattgtcaaaagaaggcacctgtcctagatttaagggaggtgcgttatcctggatggtttctaggcctcagtgggatggtctgatgacttcgtctcaccccccaggtacctaggaaggtgatgaatgtgaaggtggattcttcatggagctccacactcaggatctggtatctgaagcttcctgcattatgtcagcttatctactttgtccagctccccattagagaaatcctgctttcttaccagcataggtcactgcgctactaagaacatttcttttccttttttttcccctccagagatgtggtcttgccctgttgtccaggccggagcacagtggtgcaatcctacctcactgcaccctctaactcctggactcaagtaatcctcctacctcaacctgcacgtagctgagactccaggcgtgagccatcgtgcctggctattttttgtattttaattttctgtagagatggggtctcgtcatattgcccagattggtcttgaactcctggcctcaagtgatcctcccacctcatcctcccaaccccgtttcttttcagtcagacaaccagcctggtctttattacactggttcagagtcagctggaaaagaattctcttttcctgggccaggcaatcagtgttcaagtcccagtgggatctcattcgagtcatgtgactttgggccggttcttcacctctgagaacctcagtttctccacctgtaaaatggatgtggcactagagcctgtaccacttgccttgtagggatgtggcaagtctcaaaggtggtgatataaggggagcgttgggtaaactgtaactctcagctatctgaatgtgcgcctgttctctctcacgttaggaaccgtagcaaggcactagaagaggttatattttatatatatattattttttatattattatatattaatgttatacaaaatacattataaatgtaaattatattattatatattaatgtaatacaaatattacattttatctacaaatcatttggctgagccttggatgtcaattgggctgtttaatgccctgacgaagatctcttatacatccatatgagaaagggtttctatactggaagatactgcctctctttttacatgcaaggaccttgctaaagtgcagtttctgattcactgggtctgatgcaggactggagattgattctgcattttcctcaaactcccaggtcatacccatgctgcaggtatcacatttagtagcaagaatgtaggaaacatggtcttttctggtggctctcttgatgttttgctacacttgtatttacttgtctcaactagactccacctcctgcagtctcacatgacccatgcaactcaacggaagtcatacaacaatcactagcagtaagtacccgcagctgtagaaacaaacaaacaaatgaaaaaacccaaacaataacatttgcacaaggacccaaacttggcagtgcacctagaagagtttgtagcgtaccattggttataaacattgtacaacacaaacctaaactattacatttgtgaggggataggttgccatttcccttgcttgtttatgagcaaaaacttgagagctgcattatttttgccttcccagatagcactgaccctcagtaaatgtttgatgagctaaaagtgcctttagtgagtgggaaattaagcaaggcccttgattgtacatctattgctccaaacttcagaaaaaccaatcataacttttacagaacatctcctccctatgctgctttatttctttccatacatagctgaactcatcacctgagactcaacttccacccatcttgtcctataagttcagatttataagggcagggcaggcaaagaagcccttagactttgcttgttggtctctcctgtaaccctgaaataaccacgtttaccacgtttattcccaaagctcatattgagttcaaatcccctgttactcatttagagagacaagtggcattcatcatttttgcctctctgtgtcttcctctcccccagaacaatggcattacatgacgattaactccttttgatataaacaagtccaatggcagagtgttggatgactcagaaaacccaggcattgaaagatgcaaaatattttattgtgttcttgcattatgaagcattggggagtgttaagcatttttctttgatttttctctccctccctccctccctccctttctcctgccctcctcccctttctcctttccttcatcctttccttccttcctttccctccctttctcctgccctcctcccctttctcctttccttcatccttcccttcccttgcctcccctcctcttccctcccttcccttcccctcctttcctttccccttcccttcccttcccttcccttcccttcccttcccttcccttcccttctcttccctctcttccatcttttcatctatatctgccattttgcctaacacccatgtgctggagaagaaagaaaacaaggacttaaagagggaaaaaattcaaagaaagaaaaatgaaaggtagacagagcttatgcattttgaaggtgtgaaaattaggatttcagcctttttttttttctccccactaaaccagcaagcaggcaaataaagaaaccctgcagggattgacacaagatgagcaaagttttagaagattttcctcagaaaaaaaaccctcgcagatttacaagcagcatatctgttgtgaggatttcgaaggagatgaaaatatattgctagctatctagacatttgtcaaaacaactgaattctatgaattggaaaggatgaacgaaacaaccaatcctggggaaagaaattcaagatgggctctgttgtgttagaatttttctacaaagacagggaagttttagctgtgtgagataaagccttgcaccaaatgagaagccaacagaccttggaaaggggcgttcagtttcaccttgaagggcacttggctttgtcaattctggatatgtggtcaaacccccttatcctcatacctgtctcactccatccctaaatcagggacctgtctgatttagaaaaatagtgcctcccttttggatatggggagagggtcaggataccttaatttacagttcgccatgtctcttcacagaagggagaggtaattctccaaaaggaaaaaaggggtgctgttaccagaagaatgattcgatgctgggcaactaaaaccaacaaatgtcttctccacttggagaataagacttaatttcaatattgaatcctgttgatgtcacagttgcctggacctgacttcccaggccctgtttgttatgagtgcatttgtttccttggtgcatggcataccagtaggaatgggcacacctaatgctcagatcttggctctttttttgtttttttgaggtggagtttcactctgttgccaggctggagtgcagtggtgtgatctcggctcactgcaacctctgccttctggtttcaagtgattctcttgcctcagcctcccaaatagctgggactacaggtgcccaccaccatgcccagctaatttttgtatttttagtagagacggggtttcgccatgttggccaggatgatcttgatctcttgacctcgtgatctgcctgccttggcctcccaaagtgctggggttacaggtgtgacaaatcttggttcttaaataccattgtgcattaaaagttagccattggagaaatggctgattccagggctggggcaggaaaactacaaggtacacctaaatttttttttctcatcagaatgtatggagtggtaagaaaaaatgacaggggcatgtcgcaatgatataggagccagcttgaagggagtccaacttcaaaatcagggtcaaaatattcagattgggctttccaaatctgggataatctaagcatggaaattaataatgacagaaatggaaaacaacacatggaatccctgaatttatactgatattaaaaaaaagacaagggagagagaagggaatgagcttatttactgaagaatgtcaactaataaatgtagaaggaattagacttagaaactcaaactcttgttgggtgcagtggcttatgcctgtaatcccagtgctttgggaggctgaggcaggaggatcattggaggccaggagttcgagaccagcctgagcttgtctctacaaaaaatttaaaaaaaagaattagctgggcacgatggtgtgtacctatagtcccatgtccttgggggctgaggcaaaagaatctcttaagcccaggagtttgaggctgcagtgagctatgattatgccactgcaccccagcctgggtgacagagtaagatggaatatggaatattgctgggaagggtatggtaccagtcttgaaatatttccccacagataacttattatttcatagtaaggcaccttcagagtggagaaatatgtgggcaccatcttagctgagtaatcaagctgatcatcatatgcttcctcatacaatgcctgtacaatattcttgccaaaaatgtaaccacaaggagacaatccaataaactcaactggtgatacatgcaacaaaaaaagagaataatgggttaaagagtgatggatggagaccacactgaacaagacagggaactctctgaggatggtgactcctgagcagagaccagaatgatgggaaggagccaagtatgagaagatcttggtggaaggtgttctgggaagagggaatagcaagtgcaaaggccctggggcaggagtgaatgaggagtagaaagaccagtatggctagagcattgtggaagaaaaggagagtgatatgatgtgagattagagagcgaggtgagggcagatgttgtagggttttgaggccatatgaggaatttagttttgtttttggtgtatatagtagagattaatttttaaatggatacataatatttttacatatttatgggacacatgagatattttgttacatgtctcacatgtgtaatgaccaaatcagggtatttaggatatccattatcttgagcatttatcattcctttgttttgggaacatctcaaatcctctcttccagccattttgaagtatagaacacatcgttgttaactgcagtcaccctgccatgctgttgaactgcagtactgattttttccatctaactgtatgtctgtccccattaaccagcctctcttcattacccccacccacacactcttcccagccttcggtatctatcattctaccctctacctccatgagatcaacttttcagctcccagatatgagtaagaacatgtgatatttgtctttctgtgcctggcttatttcacttaacgtaatgacctccattttcacagtaggagttaaattttaacataccatactctgagtatgtatctgtgctgaataactatatttacccatttatatctacagctatatctagaaactacctcactaacactactcaattcagctgttggaagactttaaaatatttttggaacaacttgtgcgtatgaatttactctttcaatggtaaattttatgaaatctaactatatagtaagtatttccaatgaaaatttagcatctgtatggagatgtgttgcaaatgtaaaatgcacactagattttaagaaaagaatgtaactatctcaaaaataattttaaattcttgatactatgtcgaaataacgttttgaatacattgacttaaaatattataaattaatgctgtatgtatctttttgctttttaaaattacagctccattgagatattcacgtaacattgaaaatgtacaatttgatcatttttagtatattcaaagagttgtgtgattatctctgcaatcaattttagaacatttttatcatctcccaaaaaagccccatactcttctcagttctaattattctccaacccttccagccttaagcaaacactaatctttgtcttcttggatttgcctattctgaacacttcacagaaatggaatcatatactgtaatatttgtttttttacatttgtcttctctcacttagcataatgcgttcaaggttcatctctgttgtagcatatataggtactttattctttttgactgctgaataatgttctattatatgctacattttgttgatgaacatttggtttgttttctctttttggctctggggaataatcctgatgtaaacatgcatgtacaagttttagtgtggacatgtgttttgatttctcttgggtatatatctaggagtgggattgctgggtcctatagtttttgctatttaattaattaattaatttattaatttatttattttgagacgggtctcactctgtcgcccaggctggagtgcaatggcacaatctcaactcaatgcaacctccgcctcccgggtttaagtgattctcctgcctcagcctcccgagtagctgggattacaggtgtgcaccaccatgcctagctaatttttgtatttttagtagagacagggtttcaccatgttggccaggctgttctcgaacttctgacctcaagtgatccacctaccttggcctcccaaagtgctggaattacagacgagccactggccagcttttggttttttaaatgtggcaactagaaaatttgaaagtatatgtgtggcttgcattataattctattgcaaagtcccaatctaaccaaatcaaatttcctgagaggtccctgtcctgccaaggaacaaggaaaacagctaaacttgccaattagagatgtctcggtctcttaaagttttgagtggtcccattttaccctcccataaaacaatctttttttcaggtaaatattcagctggtttaaacattcaactctcttttggggctattccttccttttctgtcttgcttctacagatggtgcctaggttcaagggacagcttgggaggaagtctgtggttcacactttctccttggcatctttatttttattttattttatttattgattgattgagacaaggtctcgctgtgctgcccaggctggagtgcagtggcaaaacctcggctcatggcaacatccacctcccaggttcaagcaattctcgtgcctcaggctcctgagtagctgggactacaggtgtgcaccatcatgcctggctaattttagtatttttagtagagatagggtttcgctatgttggccaggctagtctcgaactcctgacctcaagtgatctacctgccttgacctcccagagtgctgggattacaggcatgaaccaccatgcccagccccctccttggcatctttaaaagtaaatcctgggcagtgtagcacttttgtcttgtttctgggtatctagcaggcttgcccatggagcagtggtagagggagcctccagaaggtgatgtctgtggcctctgcttaactcagcaggccccgctgccattcctcctcagctctgggtgcctgtctgttggtgcagggccccccagtgatttccccagctgagtctctgcctaaatgcctccctcagacctttccaaagtcacatggctccagcactatgccaagcatggagaattttcccggggaatcagaattttcttggaatatgcacctgggatgtgaggagcgaagtcttgcaatggtcattctccaacattatccagttatttctaccttccctggcttcctaccccaaagaaagaagagccaggaaatttcactagatttggcaagatgattgatgactttgattttaaaaataataagttatgtgctggtggttatctaggtctacacatctgtgcatacataataagtgtatgcttcaaatgggtgcattttattctgtataaattttatcccagcaaagttgatttaaagaaagagcaggttcaatttatatacattgtgctgggaagatatttatgatacagtgttaaaatatatttttgcatgaaagaagccagttgcagagcaatgagtagtaagataatacttttgtagttaaaacgtgaaaaaagaggaaaagctcctatatatattctgtgtttctcacgtaaacacaaagagattgtagaaaacaacacaaactgcttatctagaagaggactggctggagaataatggtgggcaggggaagggttaagtttgtctctgtatcttcctgtattgtttaactggtccttttttgtcgtgagacagtcttgctctgttacccaggctgcagtgcaccaccaccaccatgccaccatgccaccatgccaccacgccaccacgcccagctaatttttgtatttttagtagagaca
